United States Patent 12,576,115 (BACTERIAL COMPOSITIONS FOR TREATING AND PREVENTING HALITOSIS) - sequence listing, part 24

SEQ ID NO: 34 - DNA, 1826112 bp, unidentified
  source 1..1826112: mol_type = genomic DNA; note = Pediococcus pentosaceus 2
gcgcttttgacaactatttaactatatcatcgagagcaattattgtcaacaacttttttaaaagttttttttaaacaattccttgttctcaacgaccgaggcgttaacctcgcttgaccagtttaccaaacttcgttatatcttgtcaagaacttttttcatttcttttttatcaagatttgaagcttaaccagtcgtacgtgcccttcagaagagcacttaaatatattatcaagataacggggattggtcaacccttttttgaaaaaaaataaaaacgagtgaaatcactcgtttttaacgacttttacgcggtttactttatgtggtttgactacagttgcaaccatcccagcgaacattccaaagtaataggttaggattctccagatcatcatagctaagactagcttactattattaccaacaaactgagcgaagatgacactaaaaccgtattcagctccccccgctccccctggaattgggaataaagagataaccatgaagattagcacatgtaaacaagtaaccattacgatattaacgccactctttcctaaagctaataggataaagtacgggattagatagtaaaaaagcagttgcaagaaggtcaccagggctactttagctagcaatctccactgtgatttcatcctgacactctcttgatagaaggagtcgaccttctcatttaacgtcactttccaagttgtgtaacgttccttactaacaaaatgcttaattgggataaaaatagccgatatcagccgcttagtgaagttatgccaatacataatcatcaataagccaataatcaccgctaaatggattaaaaagccaaataagacgaaccaagataagaaacggattttctcttcaaggtactgaaagccgatcaataaactaaaaatgaagttgatgacgaccatggactggaataccacaaacttcattaggagaaccgagctcgctcgaccaccttcaatcccattttgcattaaagccaccaattgagcgggctgtccccccgatgaaaagggcgtgattccgttaaacagttgttcaattagtggaattcggatagcatccctccatgataaacgatccccgttgctttgaactaacattttagtagctactgcttctaacccaaggtatagcataatgcatcccaaagctacaagtagccaccacatattcagatggacaacatctcgtgccatctgattcaaattaacgtttcgtaatgaaaagccaaaaattataataccagctagaatcatcaccacaaggactactttattcctccttgacatagataaactccccctatttggtcaaagatgaataaaagtctaaccatatatcagctagatgatcttcagagtattcttccgaagcttcgtctgatagttgcttaaacttattcagcctttctttatcttctgatactaatttgagttgagtattcatatcctcataatcttgagtaggtatatagtaccccttaataatggaatgatacaactctaagtccctcaacatgactggaacaccacaactaaaggcttctaaaaccgacattgggaataattcattgtatgaaggtaatagaaataggtcggccgcattgtagtattctaccaatgcgttacgatctacaatccccgtaaattttaaattatgcggtggattatcaaccacctgcttcaaatcggcatatccatcggttaatcgtccaaatgaaaagcctcctgcccagataaaatacttatcggggttattttccgcaagtttgataaaatctttaacccctttacgttcctggacttgtccgatacctagcacggtaaaacggttattaacctccaatcgttcccgtactgcatcccgattggcctctgtaaaacggtaaaattcattcttacggacaaaattggggatataagtgataatatcccgactaatcccataagcgactaatttatcaataaacgtaggattcaccactacgatatgatccatccgcttataaaacgagataatgtatttataaaaaatagaacggaaaggttgtgggatatttaaacttccctcaatcgtttccggtaaaaagtgcacatacccgaccttaattcccctttttttagaaaaggttgataaatagaaattagggtcgatggtgtgataatgactaatatcagccttagtaaatttattgattgaaacatcgatttgctttggaaaatgggtcttcaacaaacgaatgagttcttcatacgcactgccgacgccttgcccctttaccttgctagctgatgaaaacatgttgaccttaattggcataccttaacccctaacattaaacaaaattattctgattttaacccgattctattcagaatcttcgtctaactctaaatctgtatgtgtactaattgcactactatagtaatcaacaacttgcttaccaaaataatccgctgaaatctcatagagtttcttttcacgtggtgctggatcattataagcatctggatgttcaatgtagtccttgattgcagctactaattgatcttcagtattaaacactttccctaaagaaatatcatctagtagttcatctgtataaggacctgacttagcaaccacctttaagttcgatgctaaagcctcaatatatgtaagtccttgtgattcagtatctgaagctgaaacaaataagtcagctagctgatagaaaccatagacgtgatcattgttgatctctccggtaaattggacattatcttctaaatgtaagtcatgcacttggttttccagactggcgcgcgctggtccatcccctacaattagcagttgtgcattaggtacctcttttaagatggctgggaaactatcaatcacttcttgaatattcttctcgtaggccaaacgacttagtgaaagaagaataggactattttcgtcgtaacccaatttttctcgccactgcttacgcttatttggtttttgatactgttctaggttgaccccggttgggattactcgaatcggaacgttaatgccatatccttcaatcgtatctaaaactcgttcactaggagcaacaattccatcgatgtgataacaaaaagcccgcgtcatctgtttaacatgatatggcttgagcaatttaccattagcaacgtagtgcaagtagtcttcgtacatggtgtgatatgtatgaataagtggtattttcaaagacttggccacaaactttcccatccagcctagcgaaaactcagtttgcgtgtgaacaatatccaagtttaactctttagccagctgagcagctcgaataaatccactaactgcaatcctccgatctgtaaaagatacgaacggaacactcgtaaacctaaagatgttccgttcgtatacattggtatcgaccttaggatctgtagtagtgaagatatacacttgatgaccttgcttttcaagctggtctcgtagtgtttttatcgatgtagctactccgcttacctgcggaaagtaggtgtcggtaaacaatccaatattcacagcaaatctccctttccatactaaataactatgtgttggtgttaattatattggtttaaaatgtgatatgcaaaccttgcccgtcaaccttagacaaattgtaatactaatcgattgaattcagcgggatcctctgccatcggaatgtgccccacattttccattacattaaccgtgatattagcatttaaagcagatagttcagcggtcttggtgttatcaaagaagggacttttttcacccattataaacagcactggtttcgtcgcctgttctaagacaaagcgccaatcctttttcgcatgccccttaaccaaagcccggttctgaggttgagaaaatggataggccgaatcaatggctttagagtttttgaagacaaaatcatcaatgtgtttataggctgggcggacaatcggttcgtccattacttcatcaaaattatcctccgctaaatttttaaatccgagatgccactgttggtcatttaacatcttaggtgactgatccacaaagatagctttactcaagaaatcccagcctcgaaggttaataatattccacaatactgctgctcccatcgaattaccaattccgatgggttcttttaattgtaaataatctactaattgtaaaacttcatccgctaaatctccgatttgaagatcaacgtctactcgatcagattgaccgtgatttagataatctaatcgaattactcgatagcctctttgcaaaaagaagttcacttgtcccgaccaaatttcagtattgcctccaaaacccgttaaaaacagaataggtgtaccttgtccttcatcttcaaaaaagatttgggctcccgactttaattttaatttcattgtttttcctcctagagaataaaaaagaaccgcgacactaaggtcagcggttctaaaatagtttgctttagattaaatgttgtcaacagtttcttgaactaacttgattacatcttcgttagtttcagcttctgtaacagccttttcagctaacttcttcatatcgtcagttgttaacttcttcatcaatgaacgcgtcttcaagattgaagttgcactcattgagaattcgtctaaaccaagtcccattaaaattggaacagcgatttgatcgccggccatttcaccacacataccagtccacttgccttcagcatgtgaagcatcaatagtttgcttgattaagcgaagcaatgatgggttatatggttgatacaagtatgaaaccttttcgttaccacgatcagcagcgaatgagtattgaatcaaatcgtttgttccaatactaaagaagtctacatacttagccaacttgtcagcaatcatagcagcagctgggatttccatcatcataccgacttggatttcaccaacttcttgtccagcatcgaccatcttttgacgttcgtcatcatagatagcacgggccttcttaaattcggctactgtagcaatcattgggaacataattgctagcttaccgtatgctgaagcacggagcaaagcacgaagttgtgtacggaataaatctgtacgatccaaactaattcggattgcacggtaacccaagaatgggttcatttcttctggaagtggtaagtaaggaagttccttgtctccaccaatatccattgtacgaacaacaacttgcttgccgttcatgccttcaacaaccttcttataagcttcgaattgttcatcttctgatggtaattcggaagcattcatgtataagaattcagaacggaacaaaccaacggcttcaccgccattgtcaagaacaccttgtaaatcatctggtgtaccgatattagcagctaagtcaaaatgaacaccgtcttttgaaacggtcttttcattcttaagtttttcccattcggctttttgagccttaaattcttcacccttttgttgataagctttgatttcgtcatcagtaggtgcaataattgcatcccctgtaagtccatcaacaatcatcatttcgccttgttttacgctagtagtagccttttcagaaccaacaactgctggaatttcaagggtacgagacatgattgcagaatgtgatgtacgaccaccaatatctgtaataaagcctttaacgtaacgacgatccaattgagctgtatcacttggagtcaagtcgtgcgcaacaataacgacttctgaatcaatcaaagcggggttaggaagttccacacccaacaagtgactcatcaaacgtttagtaacgtcacgaatatctgcggcacgttcttgcatataagcattgtcagtcattgcttcaaacattgaaataaagttatccgtaacttctttagtagcttcttctgcattaattgtgtcgtttttaattttgtcttcaatattaccaatcaattctggatcagaaagaatggttaaatgagcttcgaaaacttctgcctcttcagcaccaaggttttctgcagccttagctttgatgagtgaaagttcttctttagacttttccaaagcatcatgaaggcgtttgatttctgcatcaacgtcagtaatgtttttcttttcaaaagaaaggtctggatccaccatcaaatatgctttagcaatggcaatcccatcactggccgcaataccttttaatgtgccagccattagtcagatagtccttcctttttcattgtatcttcaagtgctgcgattgcgtctgcttcgtcatcaccatcagctgagatagtaacgtctgcgccttggccaacaccaagtgacataacacccatgattgacttcaagttaactgatttgtctttgtaagttaattgaatgtctgagttgaacttgctagctgattgtaccaacaatgttgctggacgtgcatgaatacctgtttctgcaattacatgaaagtcgcgtttttccataataaaatatctccttttgattacacatatatttttgacccaaataagtagtgaacgtacactaattatttataagcctttgataagaataatatcaatttattagttgcaaagcaagcccttacataaaacttaaataaatccgctatttatctttgatacgttcaaagtgataaacaacaatcccgccacggtctgcttttccaattacttgctttctttcaggaaattccataaaacgtggctggaaatcttggaactcctctgcagtaatctttagctctttgattgaaccatcctttaaatcattcaaaagctgtaaataatctcgcatgttgtcacctcacttcggtctatttattctataccattaagtactttgttatcaacaataatattacctaattatccatctttttttcaaatcaaactacttgcactctgaaatagagtgtgtataatttaggtatggtcaatattggtcaaacattatttgactaattatcgtttcacatttttgaaagaagggagacagcagatgctttgtcaaaactgtcaaaagaacgaagcaagcattcacctctatacgaacgtgaatggtcaacgtacagaagttaatctgtgtcagaattgctatcaacttttaaaaaatcaacgaaataataacattaatagaaacggaggtgctcgtatggcacaagatccatttggatttggaaacttagatgacatcttccgtgcgatgcaaggcggtaatatgggacaacccgaaaacctctatggacaacaagttccccctactcaaccaggtggtggaaatggttcaggtggtaatcctaacaaccgtggcaacggcggatcacttttaagtcagtatggcttgaacctaactgatttagctaaacaaggtaagattgatcccgtgatcggtcgtgacagcgaaattgaacgggtcatcgaaattctaaatcgtcgtactaaaaataacccagttttaattggtgaagctggggtaggtaaaactgctgtcgtagaaggattggctcagcggattgtggaaggttctgttcctcaaaagctagttaataaacaaatcgtacgtttggatgtagtttctctagttcaaggtacgggaattcgtggtcaattcgaacaacgcatgcaacaattaatgaaggaagttcaagctaacaaagacatggtcgtcttcatcgatgaaatccatgaaattgttggagctggtaatgctgaaggtggcatggatgctggtaacgttcttaaaccagcccttgcccgtggcgacttccaattagtcggtgctacaacgctcaaagaattccgggacattgaaaaagatgctgctcttgcccgtcgtttacaaccggtgcaagttgatgaacctagtgaagaagaagctattaagattctaaaaggaattcaaaagaaatacgaagattatcatcatgttcactacacggatgatgcaatcgaagcagccgtaaaattatcaaaacgctacattcaagatcgcttccttcccgataaggctatcgacctccttgatgaagctggttctaagaagaatctaacgattaacatcgctgatccggaaaccattcaaaagaagattgatgaagcggaagctcaaaagaaagctgcccttcaatcagaagattacgaaaaagcagcttactaccgtgatcaagtttctaagcttgaaaagaacaaagatggtgcaaccagtagcgaagaacaaccaacggtcactgaagaagatatggaaaagattatcgaaactaagaccgatatcccagttggtgacttgcaaaagcaggaacaagaacaacttcaaaatctttcagaaaacttgaaagatcatgtcattggacaagatgaagctgtcgataagatttctcgggccattcgtcgtaaccggattggtttaaacggaactggtcgtccgattggctccttcctcttcgtcggtcctactggagttggtaagactgagttagctaagcaacttgcgcaacaattgtttggttctaaggattccatgattcgctttgatatgagtgagtacatggagcctcattcaatatcaaaactaatcggttcgcctccagggtacgttggttacgaagaggcgggtcaattaactgaacaagttcgtcgtcatccatacagcttagttctcctagatgaagtggaaaaggctcacccagatgtcatgcatatgttcttgcaaatcttggatgatggtcgtctaactgattcacaaggtcggacagtaagctttaaagataccattattatcatgacttctaatgccggaactggtgacgtacaagccgatgttggttttggagcagctgctcaaggcaagacccactccgtccttgacaaactgggaaattacttcaagcctgaattcttgaaccgttttgacgacattgttgagttccaagccttaactaaggaaaacttaatgcaaattgtcgacttaatgattgcggatgttaatagcatgttagcaactcaaggactacacgttgatgtaaccaaaccagttgaagaacgcttagttgatttaggctacaatcctaagatgggggctcgtccattgcgtcgagtaattcaagaacaaattgaagatcgcattgcagacttctatcttgaccatccaacagaaaagcaattaaacgctaagattaaagatgatcaaattgaaattactggtgctcctaaaaaagattaaatactaaaaagaggttagataaaccaattatggtttacctaacctcttctttttttatccgcgataaccaattgccataccaataattagaattactagtacaatcgtggtaatgaccacgtacaaacggtcgccctctttagcaaaggcataaattgaaacaatcactcgtaaaacgggagttaaaattaataagaaaataccaaacatcaaaaccgcataaggtttgaaagctaacaccccatgaaagataggtgtaatccgggtcggtaaagcccccgaatatccggaaccattcttaaataaccatagaccaattcctaatagaatcactagcgctgaaatatatactcccacttgaaggacacgcccaatgactaattccacgtgttgcatctcttgttttttagcattcattagatgttcaccccaaatcctttaagaatcatttgcaatcccatatataaaagaacgggaataaaaatcattcgaatccaacggggttgtaggtgttgcataattcgacttcccaattgagctccaaacaaaattccaattgctaatggacccgcaatatcagcatgaatagaaccattaaagaaatagaccatagcactggcagccgcagtaactcccatcatcaagttactggtagcactagaaggtttgaggggcatcttcataatgttatccatcgccataactttgaaagctccactaccaattcctaataatccactggctaatccggccccaaacattacggctgaaccaccgggaacattttctacttgataatcaacgttcttcttaagagctttatcatagtagctaccatttaaattgagttgatttgctaaacgatcatttttagtactaccttcttcaccaccgccgcgacgcaacttgcggtacatattccaagaagaaaataccaagaaagaaccaaaaagcacaaaaaggacggtcgagttaaatatcccggtcataattgccccaacaatcgccccgacggtcgttgcaatttctaaaaacatcgctactcgtaagttaagcatctcgtcctttaagtatgcaatggttgcccccgaactcgttgcaatcaccgcgatgatgctagccccaatcgcatacttaatatctaatcccattgccaccgttaaaactggagtaataatcattcctcccccaattcccaagatggctccaaaaattccggccattagacccactaacagcagaattatcaaatgacttgccatagaatctcttcctctcttaatcaaaaaaactgagaagcacccctaaaggtctcttctcagtctttaagttacttactactttcagatgatgaactagagctactacttgaatcactgcttgaagacttcgaagctgagctatctgaagaactactacttgaactagatgatttatcagcattgctttctagttcaggagcatccgttacataatcatccagcgttgatttgccgtgattttgttcaatcaaactcgtcttagaactttgagctttatttagttgttcgagtgccgacttcatattgtaactgtagtctgacttattaaccttcttaaaccaatccagcttggcaaagcgcaagagatcaccgttaataatcttatctgaatattcgagttccttattaacgtaatcttgaatcttcttcacttcttgtttttgagcaggtgtttcgtctgtgacttgttcaccagtggccgtcaagtagaggtcgcccccgtacttggtatacttcttcgaaacaaagtccccatttcggaacgctacaatctggttgtattgttttgaattaatatcatgtccaaattggtaagcgcccggcgtcttgattcccagtaaattcaacaaggttggcatcacatcaatttcaccactgtagttgtggttaacaccaccctttagaccaggtgaatgaatcatgaaaggaaccttttggaacatggcaagatcatagttggttacacccttcaaacctaagatcttggcaatggccggcttatggttgttagaaattccataatggtcaccatacatcatgatggtactcttattgtacaaaccagatttcttcaagtaatttagcaattccccaattgattgatctaagtaatgcgcagtttgtacatacggatcaacggttgaatcaccggtatcccacttgtcgatagaaacgttcttcttttcgattccgtatggataatggttcgagaccgtaatcaatttagcatagaacggttgtggtaattgttccaagtacttagccgattgttgtaagaagagcttatccttcatcccgtatccactaacgtagcccttcttcaatgtgtaatattgtttactgaagaagtattggtaaccaaatgacttatacgcattgtctcggttccagaaactagctacatccccatggaaagcggccgtcgaatacccattttgttgcattaaagcgggcatcgattggaaagtattggtggttccgtcagttaccatcgccgaaccttctgccaaaccgaataaggaattttccagcatcatttcggcatccgccgtcttaccttgaccaacttgattgaagaagttgtcgtaagctaaagtatttttgtccttgtagaacttattaatgttcggcgtaatttcttcgcctttccattttttgttaattacaaattgttgaagactttccaaatggatgataatgacatttttgcccttagccaccccttggtattccacattagcaggaacattattttctttgatgaacttcttaatcggatctaattgtgaacccttagcttcttttttcttattgctgttttcaaatgacttaaccccatcatacaaagtgaaactttgtaatcctaggtacttaacaatgtagttattatcaaaggttcgcgtcaataatcctgaacggttggaataagctaaagccaagttagctgctaaaaccccgatcgatagaaccgtcactgcaaaggagttcattaacttgaacttgctttgatccatcttaacgaatccaaacgctaaaatagcaataacgaaaattacatcaataaaaactaggaaatcagtagttcgtagaattcccatcaaactctttcctagattatcggaggctgacccagaacccttaattaaattaaaggtaatgaaatctgaaaactcgcgataataaaggatgttggcaaatagccaagttgataagatgatatccataataatcatgtaccagtaggcccacttaccacggatatacaatccaatcccgaacaaaagtatggcaaaacccagcgggctgatggcgagaatcaattcttgcatgccaccttgaacacccaacgtgaattttgtttgatatgctatgtacgatttaatccaaaataaacctgtaattagcatgaagaagccaaatttagtatttagcccctgtcgaaatttaccccataaacgattcatgctatcgttcctccacgtgatatttcttgatacaacttaaccattatatattaaaaactaaaaaattaaccccatttgaggtgttaatttagaaagatttagtttttagagtttggccgttagtttaacatctgggtatttaccagcaaaccaacgttctgcaaattgattttcaaataagaataatggttgtccataacggtctttaaccaataagttacgtgaagacgacatcttttcatcgagttgttctgggtcaatccagcgcgcagtctttttacccataggttgcataactacttcggaattgtattcgttttgcatccggaattggaaaacttcaaattgaagttgacctacagcaccaagaatataatcaccagtagtgtagttggtataaagctgaacagccccttcttgaaccaattgcttgattcccttatggaaggacttttgcttcatcacgtttttagcagaaacttgcataaatagttccggtgtaaattgtggtaatttttcaaattgaatggcatgtttgccagcataaatggtatccccaatttggaagttacccgtatcataaagtccgatgatatcccccgcaaccgctgtttccacgttttcacgcgtgtctgccatgaattgagtggaattagaaaggcgtaaagtcttacccgtccggttcaaagtgacgtccatcccacgatcaaattctccagagcaaatgcgcaaaaaggcaatccggtcacggtgattaggattcatattagcttgaatcttgaacacaaatcctgaaaattcttcttcagttggttcgatttcttcaccggcttcatctttatgtgaagttggtgcaggagcgtattggaggtaagcatctaagaaagtcttaaccccaaagttagtcaaagctgaaccaaagaagaccggagtcaattccccagtagcaatcttggcttcatcaaattgattgccggcttctttcattaaagaaacttccatcatggcgtcttggaaaacactttcctcttcaatcggattgctttctttgagttcgccgtcagcattgagttccaaaaattctggttcatcagtatgtagttcaatgcggttattgtaaatatcatacaatccggctagtcccttacccattccaatcggccagttcatcggataagcttctacacctaagacttcttccaattcattaaccaagtctaggggttcgcgtccatcccgatccaacttgttcatgaaagtgaaaattggaataccgcgcattttacaaatttggaaaagctttttagtctgaggctcaatccctttggcagagtcaattaccatgacagctgaatccacagccatcaaggttcgataagtatcttctgagaaatcctcatgtccaggagtatccaagatgttaatccgtttaccagcataatcaaattgcataaccgaactagtaaccgaaatcccacgtttcttttcaatttccatccagtcagacttagcatagttgccagatttacgggctttaaccgttccggcttcgcgcacaacgcccccgaagagcaatagttgttctgtaatcgtcgtcttaccagcatccggatgggaaataatggcaaacgtccggcgtttttccaccgcattttttaaatcttgttgattcatagtagttcctttccctctaaaaaataagattggaatcgtctagacatcccaatcttagtttgtagtcctaatcttttttgtaatcgcctagtccaaggtcttttttgatcttagtagttgagataccagccgtacgtggcaagtagacgaccttgcaataatcctttagaaaatcaaattgaccttcccagtcgtcgcccatcacaaagatgtcgatgtcatggtctttaacatcgctaatcttttgatcccaatcacgttctggaataacttcatcaacatacttgattgcttccaaaatgtacttacgatcttcaaaagacgtataagcttttttgcccttaatggcattaaattcatcagtcgaaacacaaacggttaaatgatctcctagtgctttggcacgcttgagaagtcggatatggcctttgtgtagtaaatcaaaggttccgtaagtaattacttttgtcaagattttttctccttgaattatattattcaactctgtagatattaccatactatcattatatctaccaatttattatttatttctgaggcttaattttttcttcaatgatttcttgatctaacttccagatgtgatgaatgaagttaatcaagactttaactatcgcatatgctggcaccgctaaaatcattccgagaatgccagaaatcttcccagacaccaacaataaaataataatggtcaacgggtgaatttggagtgacttaccaatcacattaggatagataaagtttccgtccacctgttgaacaatcaataccacaataatcactgaaacaacttggcccggtgattgagcaattgccactagtaaggatgggaaaattccaaaatatggacccacataaggaatgatattgcagattcccgcaatcactccgaggagtaagccgtaaggttgttggataatcatataaccgataaccgtgaacgtcccaacgaacaaacattcaatgacttgtccagaaatgtacgaagataaagtatcactcatggtattaaatagatccaccacatttttacgattccgatgcggaaccacttgggcgaccgtgggaatcaatttgtaaccatcttttagcatatagaacaagatgattggcacggtaatcaccaccactgtggcattcgttacggtggaaatcagattaccgatatgcagggccgtccctgctaaaaagccttctgcatacttaccaatctcactattgatatttttgataaagggcgcgaagtcaatcttcttcaaccacgaatgctctaacaactgtgggacggtcttttgcaaccttttgacaatgtaaggcaagtttcccagcatttgggaaacctgatcaattaaattcggtaagaaagaactaatcccccatacaatcaatgtgataaataggacaaacacaatcacgattgctaaggtgcggggaatcttaaacttcttgtaacggaccttagttaacaactttaccaagggattgagcatgtaatacaaaaaagtggctaagatgattggcataaacacggtactaataaacgtcccaatcggggtaaacagaaaatcaatcttcgtacacacccagattaaggtcgctacaatcagtagttccaaagaccaatacatcaatggcgtttttctaaatttttcaaacataacgtactcctcgcatgatatcgtcattctaattttaatattttttacacaaaaaggaagtgttatgcacacctccttttttatcgagtatttcgctccgctatatttagataacgtttgtaccaaatattaataaactcgaccgaaaatggcccacgtttttcatcaatccaacccgttaattcgcgaacgctatccaataaaattttgattgtatcttgaggatagcgccattttttactgaattgttcaaattcgtccatatcaagtaggcgccgttcgccatttggaaaaacctttacgtccaaatcataatcgacatattttaaggcttcgcgatccaacacaaacggcgacgcaatattacaataatacgaaaccccactgtctcgaatcatcgccaccacattgaaccacgtatgtttattaaaatacactagcgcaggctccctggtcacccaacgacgaccatcatcttcaatgaccaccgtatggtcattacatccaataaactcatcttcgttgtttttcaggaccatggtctcacgccaagtccgatgcaaactcccatcatgcttatagctttttatcgcaatatactcgccctcttttggtctttctgagtactgagacatagcctaagcccactttctacagctgaaagctttgaatttctcttcaattataacaaaaccagccttagatttgcaccatgctttaagctttcctacagaattctataactcattttcacgcatgaaccgttcaatcaagtcaatttcaaagcctttgttgtacaaagcctgcttgattttggcttttttactataagcgggaagccccgcatgtttgcgaattaaacgttcacccaacttaactaagttttcatattcggcttcctcgtcaaccttaaattcgatttcctggagtgctaaatcaatcgtagccgaattaaagcccttattcatcaaagtctgtcgaactttgagtttctgttgtttaagggcggaattactttggcgtttttgaattttgctgccgacttggaccgccagctccacttggtcttcggcggtgaaaagagcaaggcccgtttggatatcattctcgtaaacccctttttgacgcaaatggttgattagataacgcgggcccttgtcccccgtcttcatcatcgtccgaacataactcttggcgtattcggcatcatccagcaagttcaagtcagccagcttagctaacacaggaccaaccacctcttctggaaaatccagcttgaggagtttcttcgccacctcatcttgcgtccgcaattgacccgttaagaaatttaaggctttattgtaggcttccgcactcgtctcgtattccccaatctcttctaagagcgcgcccgtaatttccatccctttacttaaacgaaaatgaataaaggtttcttcactaatgggaaacgcatattcaccattaagaaaaacattgtagcgaccggcctttttctgggcggtaatcatggtaatttttttagtttctgctgaattaatgttaatcagctccttttttgctatactttgataagaattaattggaaagaaggttacttaaatatgcccactgctaaagtagtttttgccactatcactggtaacaatgaagattgcgccgacatcatcaccgaagccctagaagacctcggcgttgaagttgatgaaactgaaatttcacaaacggatgctgccgaactaaaagattatgacattaacgtcattgttccttacacctacgatgaaggagctctaccagaagaaggaatggatttctttgatgacctcgctgaacttgacctttctggcaaagtctttggagtagctggttctggagataccttttacgctgaatattattgcctagcggtcgataagttcagtgaagccatgactaaagcccacgccattcaaggtgcggaaaatcttaaaattaaccttgcccctgaatcccaagaagatttagaccgtttggataattttgcaagtagcctagtggataaatttaacgcccaatagctattaataatataaagggagctgtgacagctgctagataactgacgagttatcgtagcttagtcacagctcctttattatatcgaaaattaatacaatgattactggttttgccatttagcaatggcatctagaatttgtttcgacgctgttccgtccccatacggatttttagcttgagccatttggttgtaagcctccgtatcattgagtaacaaggtcatttgtttttttacctctactgggtcggtaccgaccaacttcaaagttccggcagcgactccttcgggacgttccgtcgtatcgcgaagcacgaggacgggtttaccaagggatggagcttcttcttggaccccaccggaatcagtcataatcaaataactccgagcagcaatattatggaagtctagtacatctaaaggagcaattaacttaatccgagcgtcattacccagttcctcttccgccatctgttgaaccttagggttgagatggacagggaaaatcacttccacatcaggcgtttcatcgaccacttggcggatggctttaaacacccgttgcatcggagcgccttggttttcccggcgatgcatggtaactaagataatgcgatgttcggccttaatttcgtcaagaacctcattttggtaatctttttggaccgtatcatgtaaggcatcaatcgccgtattaccggtcacaaaaatttgtttttgtggatgattttcctgaagcaagttggcttcactggttgtggttggagcaaaataaagatccgttagcacatcggtcatttggcggttcatttcttctggaaatggggaatacttattccaagtccgtaaaccagcctccacatgaccaacagggatttggtgataaaaagcacttaagcccgctgagaaagtcgtggttgtatctccatgtaccaaaatcaaatctggacgatcgtgatttaaaatttcgtccatgccagataagaccttgctcgtaatgctactcaaagtttgactcttttccatgatgttcaaatcataatctggtttaatctggaaaatttgtaaaacttggtcgagcatttcacggtgctggccagttactaccgtgatgggttcaaaccggtcatcatttttcatggctttgaccactggtgccatcttaatggcttctggtcgtgtgccaaagatactcattactttaatctgcttcattttataaccacccttcaacttctaagagtattatatcagcattcctgcataaaatatgctaggatagtaaaaaaataaggaggttttcccagtatgaatgacagcgaacttgaaaagaatttaaagaagtatgcccaattaatcacccgcgttggtgtgaacgtccaaaaaggacaaacgattatcctatatgcttccgtaacgcaaaaacatctagccaacctgattaccgccgaagcctatgctttaggagccgcagacgtaattttagaatggagcgatattgaaactactcgccaattcttaatgcatgcgtctgaagcacggattggtcaagtttttgattacgaaaaagataaatggcaattcttagccgaccaacgcgtgtcgcgcatcagtttgattagtgatgaccctaatgccctcgccgaggttcctagcaaacgcatcgctgcttaccaagctgcccaaggtttagctaagcgcccaatcatgcaagtcactactaacaacgatattagctggctggtggtggccgccgctgaccctaagtgggctgaattggtcttcccagaattaaagggcgatgaggccgtccaagccttatggcaagccatctttaaaaccacgctggtcgaccaagcggatccgattgcagcttggcaaaataaaattgcggaccttgctcaccatgcagattggcttaatcaacaagctttcgctgccttgcattaccaagcccctggaaccgaccttactgtaggtttacctaaaggccatatctgggtcgccgctgatgccaaagatgcagctgggaacaccttcgtcgctaatatcccgacagaagaagttttcactgctccagataatctccacatcgacggtaccgtaacttcgacgaaaccgctaagctatggaggcacgattattgagggaattcacctcacttttgaacggggcaaagtaattaaagcaaccgctgatcgtggtgaagaagtgctcttacacctcctccaaaccgacgatggtgcgaaatcactcggcgaaatctctttagttcctgatgattcaccaatctcacaatcaaatacaattttcttcaacaccctttttgatgaaaatgcctctgatcacatggccctgggagaagcttatccattcaccatcgaaaacggaagttcaatgaccccagatgaattacaacgtcatggcatgaatatcagtcagacccatgttgatttcatggttggatcggatcaaatgcatattgatgggattaagcccgacggtagcaccgttccggttttccgaaatggcaattgggctaaataataataattaactaaaaaacagcatcggtcgcaattgcgattgatgctgttttttctggttaacccagtataagcgcaaacctttagttcagatttgcgcttaagttgagttatttttttagattttggtgttggagatgtgtgagcaaaaccgggttggtttcatccacactcttttttctgaaacctgttcccgaaacctgccttctccggttaacctaatgcagacacaaatccatagcccggatttatatctccatcatgttaatcctcaaagccaacccggtttcgctcacactctttttttatttgaaacctgttcctgaaacctaacctctccggttaacctaatatcgacacaaatccctaacccagatttatgtcgatatcatgttaatcctcaaggtcagtccggtttcatccacactcttttttacaatacatcaccattaaaaatcgaattcttcacaatcacataatcgaccttacggatggcttccaaatctctaccacccgcataggaaatcgatgattggagatcttcgcgcattgcttggagtgtatcacgcaaatgtccacgttggtggatccaaatcttcttaccttcgacgtttttagcttcacccttttggtattgcgaagcactaccaaagtattccttatacttcacgccatcttccaccttagtttcacccggtgattcgatatgtccggcaaacaatgaaccaatcatcaccatagttgcaccaaaccgaattgatttagcaatatcaccatgagttcggattcctccatcagcgattaatggcttacgagctactttggcacaccaacggagagctgacaattgccaaccaccagttccaaaaccggtcttaatcttagtaatacatactttaccaggtccaatcccaactttagttgcatcggcaccagcattttccagttcgcggactccttcaggcgttccgacgtttcctgcaatcacaaaagcagctggtaatttttctttaatgtagtggatcatgtcgattacactttgggcatgaccatgagccacgtcgatggtaatgtaatcgggagtaagattttcttcagcaagttgatcaattagtgcatattcatcgtctttaactccgacactaatcgaactaatcaagcctttgtttttcatctttttaacaaagtccattcttctttcaggttcaaaacgatgcataatgtagaagtatccatcttcagctaacttttcggcaatctcttcattgatgatagtttgcatattagctggaaccacgggtagtttaaaacgatgttctcccaagaccactgtaggatcacattcggttctactacggacgatacattttgctggaattaattggatgtcttcatagtcaaatactttcatttttgtcccctcgaagtgcataaatttggtgtacttttgtcaccacgaaataatatacactaactttaatcataaaacaagcatttaatgttcgctttcttctttaaaatggcacaatcaaagtcctgaaaagaccatatcaattcatttttaacgaaagataacccgtaaaacgtgataaacaggctcaaccactgctttacatcgttaaaaaatcgtgcgaaaatgaactagttaagtctccgtggctcaactggatagagcaatcgcctcctaagcgataggttgcgagttcgattctcgccggggacatttgaatacagacagaaatgttaataatactgggatacgttaatcatatgcgaatcgcacgtgaatcaaatcataaaaaatcacccaatcttaattcgattgagtgattttttcatatcaaactaaaccaaaaagccatctagtccaacaacattggattagatggcttttcgtttaggactgtaaaaagaatttcctaatttctcccgatgtagtcggcgttgacctctaaattagaagtctaatccagctacctgtactctaagtcaaaaaattatttgttttctttagctttgttgatgtcttcttcttttagctcttcgtatttaactcctgtgactttttccattccatcacgagttacaactaattgcttaccgaacttacggatggtgccttccggaaagcgttttggatatttgttataaattgtgcgaacataatccttttgcttgccccacatcaagctagcttcgcgactgccaatcagttcatcagagttaagatcaatcttttttgacattgtcattccccttttctctatcaataatattacaatataccgttggatatgcttacaatatttataatagcaaaagcaactataaaatacctatcaaaaggctccatacatcgttaagtttagataaacttaataatgtacagataattccttatacgtctttaatgtagtatttttattgtacacaatctaacttcatgtattttatcataaacaacccttttttgcttataaaaataatacatattaacaaaaaactctaaaattggcggttaagttacgccaaatttagagtttatctaaccctatttctttttagcttcactcattcgaacgactacccgcccgtgaagatcatgcaattcctccgagcgtgggttagaaacgctgttcggatcgatttcaattaaaattgagttttcatatactttgccaacggttccttcgaatccggttggtagtaaatcggtctttgctacggtaacttcgtcaccaacatcaaatggttttttttcttcttttactgcttctgactctgctgccataattctctctccttagtttcccttaatttcctgcattgatattagcttcttccacactactatcactggtattagcactgcttgctgacaaggctaccgtacccgtcttttcgtgttttaagcttaatccattacgaataaagttagttacccgttgtaactcagtgttcgaaacaatttccatagattgaccattaatcatctgtccatccccttgagcatgagtttcttcgatgccgccagttgatgaacgatagtttttagccaagtcaactagatcgtcaaaggtaaagtcggtcttagtttcattagaaattgaatcaataaaatctttgtttaataagcttgatacagaactgctcttgctgatgatagcagttaacactgctcgttgtctagtctgacgtccatagtcattttgaggatcatcgtagcgcattcttgaataagccaaggctttcttcccgttcatatgggttttaacccctttagtaaaggtatatccatcatacgtaaagctcaaagttggcgtgatgtctactccaccagcttcgtcaacaactttttccataccgcccatgttaactaaaacatagaaatcaatcggaatgttgaatacttgttggacagttttaatcgccgttccagcttgaccaaaggcataagcagcattgatcttagaaggtgacttcgattcataacctggaatagtaacacctaaatcacgcggaatactagtaatcgtggtctttttagtcttcggattaatggttaccaccatcatactatccgtccgtcccttatatgaacgacctaaagcccccgtgtcagttcccattaataaaatcgaaatgggcttcttaccatttaacaaactatttgtattacgttgttttttaattcctgcactactataggtgttatccacggcattcttcacattttgatacttccgaaaaccgtagacccctcctccaagtaaaataactgccagaacgattaaaatcgtgtttcgcacagtatgcgatttttttgtatgttctctacgcataaaaatatacccacctttcaacagtgactatattacactatttaggcctttttttaactataaaaaatataattaaccaaaattcaataaatttataactctttcttaacgcgccgcattcctttacgcttagaatgtttctttttacccttcttcttgggggttgcgggagggttatcaaattgcttttggctctttgctttagagtttttaggagtcttagccccggcttgtgatttttgttcaggagctgattttttggttgaagtagccttgatcgatggtgctttaggtgcttcaacgtattcactagccaaaatgattttccggttttggatggctaatttttcagcctcaatccccaattcctttatcatctttcgtaagtcacgaatgtcatgatcatttcccagactgatgacatacccatcttgccccatccgaccagtccgccccacgcgatgcgtataggtagtagcattgtgaggaatatcgtagttaatcaccgctggtaaacgatcgatgtctaagcctcgagccgctacatcagttaccattaatagtgacaattcctttttcttaaaacgtcgcatggctgctgcacgatcaatttggacttgatgtcccgcaattttaccgacatctacgccttcatgcttcaataaagccgctgtcttttccatcgtcgaaacgtggttaaaaaagaccagaccttggaagtttttaactcgactaagtcgttttaaaatacgtgctttcatcttttcaggcacttcaatccaaccatgttgaacgtgaccgcgagtgttgtcttcagcacggacgtccaccacttgtggatgcacatcaaaccaagcttccaaatcatctagcgctaaatcgttagtagcggagaagaaacttaattgcacatcggctaggagttgatcttcaatttgacgagttccttcaaggttttcaccagttaggagttcatcggcttcatcaatgaccaagctttgaatttcactcacttttaagcgacgttcgttaattaacgttaaaactcgaccaggagtgccgaccacgatttccggtttcttcttcaagcgttcgatttgacgttggacgttggcaccccctgtaatcgaagtgacccgaagtccaattaaagctgcccattcgcggaaaacatccgtcgtctgaatggcaagttcttgtgatggagatagtactaataattgagttccatcgccgggcgtgattttttccatcaacggcaaggcaaatgcgagggtctttcccgaaccagtgggtgaaagtccgagtaccgattccccatttcgaaggggttcagcgactttttgttgaatcaaagtcggttctgcaaaacccttttcgttaaaatgctttttaaataaatcattcattaatgtttagtcctcttctttttcattggtaaaatatatcttaccattttgacggagattatatagtagtttatttacatttcgacttatttctagccaattttgataatcggtggcgtttttttcattttccggatcattaataacgcgtgcaaagtcacgtgcttctgcaatcatcggattatcatctggtgcttcactaatcaccgttcgttgaccttgagcatcaatatattcaacttgattgagctcggccgcattatccatgacaatactgtccttaacgccatagatttcagacgcaagttctgaattaacgttcttcccaatatttaaagtcacatcaaattcgggatagcgtagaatggcaacacccttaccatcagctcctgtccgcaacttttgggcgaagtaaaccacttcttccggcatcccaaaccaagctactgcatcgtacgcaaggtaaacacctaagtcttggagagctccaccagcaaatttcaatgagaaaatgtttggttcgttgccagcgaggtagctatcataacggctggaatatttagcataggttaacgtagccccttggactaattccaactcgccgacttgtttttgaatggcttggaaattaggctcatgtaagtgccgagccgcttcaaataaacgagcttttggatgggcttctagagtttgatagagttcttcccattccgttggattagcgacgattggcttttctactaccgcagctttgtccgctgccaagacttgttgggcttgttgaaaatgcaaactgtttggcgaagcaatgtaaacggcatcaatttcggggtcgttagctaagtcttcaatctgatcatagaacttagtagcaccattcttttcaccaaatgattttgctttttcaatggtccgtgaatataccccaactagcttccattcgttggtagcgtgagcagcgtcaacgtattgttgtgtaatccaattagtaccaataattccaaatttaatcatggtagttcctccttttaatttcatacttctattttaccttaaaactacagtattacggaattatttcactttaattcattttattaacaactcctaaaaacagagtcttttcactacttccccggtttaattaatggtatatttaaacggaagattgagagaaggagttgaagcgatgaactggcaaaaaaatgcgttcggtgaactattttcattcattggacttgattcaaaaaaaccggctaaggatcctaaaggcgtgagtccatttttctttgctgggacatggttgtatcacgatcaaactactaatcgggagcatgaattagacatccgtcctaactatgatgtctatttggatggcaaattgctcaaaaccgtcgtggaagctctagatgattacggaattacctttatcgaccgctttggctatcatttaataattaaagcgaatgattatcgtcccatcagtatttatgacgaagcgaataatgaaacctatgccattattgaaactaaaaaaaataaagagttgtgagtaaccccgttcggttacctacaactctttttagttagtctgttcattccaagtcttttgtgaaccattaaaataggagaccggaagttccaaatcactatgatcatttttaaatttttgttccgcatcgtattcaacaaattgaactcgccgattgtgctttttaatctggggttcttctagccaaaacttactttgtttaatgtaagtaggatccagttgtcgtttaatggccggcgtcgtcttaatcacaaccgcctgtccatagtaattagctagcaatttaaccaagtcagctaaatcgggacccgcctttttccaatcaacccgcttagcattataatccccatagtaactcactcgaatcaccacgggcagctgtcccgtattactcttgaccttttggctaataaaacgcagttgggctttgggacgcttttggaaactaaagttatgcacaataccaactttaagatcagtcgattgaatccgactataatttgtattaaaactatcatcaaagtaagtcgccccggtcgtggcattgagatacacaaatgaaatgtgctgcttttgtaaggaattaaaatcgataatgccattttcctgatcaatcacacagccatgaacgggatacggcgctagcgccaaccgtgccccgcgttgttggtttttaactacccagacgccagccgtggctagtagcaccacgagcagaaaagctcctaaaattattcgtcgacggtgatggacaaatcgcatattaaatttaggccgatacttagcatgtcttttacgctccatgggctacctcctttttgaatattgtactctaatctaatccaatattcgaatcgatttaactcggtagcctactactagttagtcagcgtagaattgatcaaaagctttttgcatatcagctgggacattggcccaaacggcttgaggagtaatgacggacgttccttgggcccgtacaattgaaaattgatcaaagcccatgatttcttcaaacattttttggagatagaaatgggaaaattccaaaggcgtataacgatcatggttcgtatagatggagccactagcttggagtaatagcacccgataatcatcggtcatcaatcccacggatccgtcttcggtgtatttaaaggtttcccgggcaatcataatattatccatgtagtctttcatgcgggacgtgacgttaaagttatggagcggtgccacaattacaatccgatggtgttccttgaattgagccagtaagtgcgctgattgatcggcaactgcttgttccgtagctgatagtggttctcctgcgatttgtttttgccaaacatccataagttggcctttttcaatgcgagggacctcgatatcataaaggtttaaaagtgttagttggtcagcggggaaacgttcttggaatttctccataaataacttttggagcttaatggagtaatgttcctcattagtaaaatctggatgggtgttaataattaatgttttcatctttaaaatctcccttttcacttcgttaaaccgagtatataataaaaaggcgccaaaacatggcaccttttaaataggagattagcaattgaaaaaatcagaacgtttaaaccaagaattaatctttctcagagacaagtattcctttcaactaaaggatctcatcactgaatttgacatatctaaacggacggccttacgcgatattcaagaattagaagcgatgggcctagcctactataccgaaccaggacgcaatggaggttatcgcttattgaatcaatccaacctcatcccaatttattttaataagaaggaagtccaagccatcttctttgccttgaaggctttgcgagtactttctgtcaccccttttgacgaatcttatgctcggattcaacaaaaactatttgcgacaatgtcgccggaaaatcagcaggatatctccaacctgcttgcggtcgtccactatcataatgtggctcccgttggtgacgtcgccaaccttgaaatcattctgaatgccatcttagaagaacaggtcatccaaattcattacacgcaatatgaggacgtccacattcagctccaaatctacgaactcttctatcgtaatggaatttggtttacgagtgcctataatccggacacccagcgctggggcacttaccggtgtgattatatgcatgatttaaagataaatccgactaagacccctaccttaacgctggcagaactcaaagctttacaagaccagtatgaaagtacctaccataacattccattcaaatgccggttaacgccctttggtaaagagcttttcttaaaacatagttaccccaacatgcacttagaaatgattgacgatgtgccttacatcgtaggtggctacaatcgagctgaattggactatatgacccactacctagtttcctttggtaaacacctgacgattgaagcacccgaacagcttaagaccagctacttaaagcaactacaagccatgatagctaaatattaaatccacctttcagctagaaaggtgatttatttgttagataattaccactcctgagcaaaattatttataatagtaaaataagtcttaaagcatatagaggaaagaatttatgaataaaaacgaacatactcacctgcaaaagaacatcgggctctttgcagccttttcgaccgtgatggggacggtgattggagcaggagtctttttcaaggtttctagtgtaacagctagcacgcaatccgcgggactaagcctgttagcttggctagctggtggtctactaacgatttgcgccggactgaccagtgccgaattagcttcggcgataccggttaccggtggcgccattaaatacctcgaagtcacttatgggaaactaaccggttttctattaggctgggcgcagaccttaatttacttccccgctaacatcgctgccctttccattatttttggaacgcaatttacgaacctctttcatttgaaagctggactaatcttaccaattgcggtcatctgtggcgcctcaattacgggaattaatttactagggaccaagcacggtgcacgtctccaatcggtggccttgattgctaagttaattccgattgcggtgattattgcctttggactttttgctccaagcaatgtccatcttagcttgattccggagcattttacgacttctcaaactttaactggttttagtggcggattgttatcaaccctttttgcctatgatggttggttaggaattggcgcgattgccggggaaatgaagaatcctaaacgagacttgccccttgccattggtttgggactaactggcatcatgatcgtctatcttggcattaacctggtctttttgaagacccttccaatcagcgatttagcgggcaatctaaatgcagcttctaccgctgcggggcagctctttggtaacatcggtggaaaactagtgaccattggaatcttaatctccgtttatggagctttgaatggttatacgatgaccggaatgcgcatcccctacgccatggctaaagaagattctctgccaatgagtaatcaactaagtaaattatcacgcacagcggtcccttacgtggctggaatcgtccaattagtaatcgctggactaatgatgattgttggttcctttgacctgttgaccgacatgttaatctttgtcatgtggatctttaatgttttgattttctatgcagtcattaagctacgccgtacgcaaccagatttagtacgcccatataaagtccccctctatccatttttaccagtagttgctattctaggtggaattttcgtcttagtcacgacgattattgaccaaccaatattggccacaaccggaatagttataactttattaggaattccggtttaccttgtaaccaagcgcaaatcatcataagatagatggtaaatctttaaggaggagactacttatgttcgtaattaaatatctaccgtttctcggtctctccctgttgatcgtgattggttgtttagtggcatttgagcgacgtccaagtgttaaaagagcgattgtatatggaagtctagcaatttatctagtatgtgtagcatggctattatttacaccaggacaatatttcatcgacccctactactatgatgtgcgctacttctattggcaccatgctaaaatcatttatatcccgtcagccttacgttcgatgggttcattcatgaacatcgtgatgacgattccagcaggagtttatctaggaatccttttccataaacatctgaattggttcctcgtagtgatagcggctggaatgaccggcttgttcaatgaagggatgcagttagtactcgacgtgttgatcaacattcaaagaaccgttgatatcactgacgtcattactaatgcttgcggagtcattgctggttacattctcttttcagcgtttgttaagccattaatgcaagataaaaattaaaaaactagcgaaaaggaaaatcccttttcgctagtttttttttatacaaaagtgattctaatcctctgtaataatccaaccatcaaggtcgaagctaagacagtaataaaatatactcaccctcatgaaagggatatcacttattacttgaaacaagataaaaatcactatgtaagataccgtgttactccaatctttaaaggcaataatcttttagcctcaaggcgttcaaatggaagcccagtcaattggagataattctattaaatttaatgtttttatttttaatgtttaagatggtgttaagttaaactatttggatgaaactagtcgtgtttaataatttaaattattttctaaaataaaaagcaaaatttactatgaaaaaatccacaataattttgctttttaaattctataaaattatatgatcctactaattagatttttgctttaaatatttcatcggatataagaaaaaatcaagaaattttatctgatgtataatttcaaaaataagtatagatataaaccaagctccaatcacccctataaataattggacaaatacttgcgttacaccaaattttagtaaaactattctaataacacttgcaactggcatatgtattaagtaaattggcaaggaaatttttccacactttgtaaagcatttgaaaaatacattattctcattaattgaaggaaaaatagaaaaagcaagtaaaacactgataggaaaaataattcctccccatcctggcatagagtaaccaatttgtgtcttaaaattaaatatcatccataaggttaaatatgtaacataacatcgataggtacaatatatactttttcaaaggtatatttcttaaaatttttccaaaaatgaacataggcgtccatattaaaacacgttgtataatgtaaacattcgttggaaatactgtcactactatataaccaagtaaagatataagaaataaaattttttcattttttataaacaaggataaaaaacccatatagataaaaattccaaacaaaatataaagaaaccataagtggtcaatcggatatttatatatattgagaaatgtggaaatacttattggtcttctcacacttccccctccaatttttttcataactgtcattaccaaactaaacgcaacatacggtattcctaatgagattatttttttcttaaacatgtacatgaattcatttttagaatttaaagttttgaaaaaaaacctgataatgcaaaaaagacgggcatatgaaaaacatataccatttgcactattagtaacaacaatttagtactactaacaaaatttcttgattctaatagtcctagtgatacatgccctataacaactaacaaaatagtaattcctttagctaaatctatccatttaattctttgcaccatatatgattctcctccaaataataccaactgttaaatttaatgatacctgaaatttttaggttactctattattagttacatgattaaaataagacagcccgacctgttctcaaaatttatgcttattgtcttttaaaaattcaactataactttcataaaaggcacctttaaaatccaacaaatcaccatatatactagaaaaccagttaaagcttccattactaatattataaatgtcatatttaatttgctgtttaaaacacttactactaaaaacataaccaaaccagctaatagatatttccagaagccattgaataatctaattatatttatttgtcttctaataaaatataattgcagaccagtagaagttatttcagaagcaaccgtagcaatagtagctcccgtaactcccatagtatagataagtggaacatttaatattaaattgactattgcgctggcacttacagcatacgtatattttctaatttgattagttgggattaaatactgatttcctatcatgactccccaaccaatcaagaaaataacaatcgattctatcatcatcaaatgtccagttattgcaaagtcttttcccataaaccataccgcaaatttcggagcaattgctgctaaaccaaatgataatggaattgaaatgaaattaataaaacttcctgatgtatacatatattcatttagttttttataatctttattggcaaaaatacttgccatccttggtaacataactgtaccaattgaagttactatagcaagaacaattttaactattcgatcagagtactcaaaatatcctgcactctgtaccccactaatatttccaagcatcgtcttatttaaaaccaaataaatttgaattgctatctgtggtataaataaagaaattgacggttttaaatgtttcaataaactgatctgtttgaaatttggttttctaacatacttttttaaatatccccataatgatagattcccaaataaaagtgacaaactaagtattagtatatatatgccaatatcattagcatttttgaccattgtaaaaatacatactaatgaaattatctttacgataaagtttctaataactgttattttaaagttttctaatcccataaaaaaccaagatatatcaaacgctgctgctatgatttgatacgattgtgcaacaaaataagagtaatactgtgttgtcatattcaaatatattaaaaatgcaacgtatgcgatgaagattgtaacaaaccgtaaaatggatatttcccaaaatgttttacttaattctcttttgtcatctctgcaatatgctatttgtctattaccataagtactaataccaatgcttccaaaaagaataaaatattgaataatagaattagtatatgcattaattcctacaccttcgctacccaatactctagaaatataaggtgttgttaccaaaggaactagcagaataaacacttgataagtcatattaaaaagaaagttttttactattttcattgtatttcacaattccttttccaagtgcttatttatcaaattcatgttcaacggtttgtaaagctgccataatcgtttgatccatattgtagtaacgatattgacccaaacgaccaccaaataatacgcttggtgctttagcttgagctaactcaacatactttgtatagagttctttattacgcttgttgttaattgggtagtatggttcatcaccacgtttccaagttttgggatattcgtgagtaactacagtcttattcttattacccttaccaaattcaaagtgtttatgttcaataacacgtgtatatggtgtttcggcgtctgtatagttaattacagcgttaccttgataatcatctacatctttcacttcagtttcaaagcggagactacgatattcaagttcacctagttcataatcgaaaaattgatcaatcatgcctgtaaaggtgatctttgctccggaattaatatattcttctttatgatcaaagaaatcaacaccggtctcaacttcgattagttcgtggtctaacatcttttcaataatttgagtatatccacctactggaataccttggtatgggtcgttgaagtagttgttgtcgtatgtaaaacgtactggtaaacgacggataatgaatgaaggtaaatctgttgcagcttgtccccattgtttttctgtataacctttaactaatttttgataaacatcgggaccaactaaagaaattgcttgttcttctaagttagctggtttgccctcaagcttaacgctcttcttttgttcctcaattttagccttagcttcatccggtgtaatcacaccccaaagtttattaaatgtgtacatgttaaatggcatactgtagatttcaccattataattagcgactacagtattaatgtagttattaaattcagcgaattgattcacataatcccagacatttttcatgctggtgtggaagatatgtgctccatattgatgcacttgaattccttcaacttctttagtgtaaatatttcctgcgacgtggtcgcgcttttcgatcactttaaccttgtgtcctcgttttgctgcttcatgagcaaatactgaaccaaacagtcctgaacctactactaaatattcttgcatattttttctccttaggtgtaaccactattacttcttaaaatttctaagtttacaaataaattcatgctattattctcaaaacagaaatttaattcttctttaaaataattattctaagtaatttccatagtctaatttttattaaaaaaaacatagcttgaaattttaaattatctttagttttatcagaaaataaaaaactataacattttccaaactgatcgttagtactatctttgaacttgagtaatttttttattgttagtttaacgttgttatcttgtatatcataaaggcttattatttttctaatatgcattattaaattgttattaactaatatagataaatcttttttgcgatcttttgggagacttaggttatgatttgctataaaggaaaacaattcttcaaaaccttttataacatcaagatgtgtagataccggtttatgcggattcttagttatagaaccaaatctttgcctatagcaatataaagatttatttatatataaaggatttttggaaagtaaaagagcttgggaactaaagccaacatcttcaaatacagtatccttaggaaatcttatcttcttaattaaattaatagaatacactttattccaaatcatcgttcccattccaaacattgttaaagatactttttggttagactttttactatctgttccgtcgttaaaagttatgtagtcaaatactagcaagtctggatttgatactgtgttttttcgcaaaactcgaaaataatctttctctatcaaatcatctgagtctaagaaacatacatactctccatttacttgttccatagcaaagttttttatattagccgggcccatatgcgaacaattcaaaatttttagatttgggatccttttactgttgataatttcaacggtatcgtcagtagacccatcgtctgcaattataatttcaagttttttttcttttgtctttatcaccgattctaaagtttcgagaatagtatccgcagaattaaaagttggtatgattatgctaaacaaattaatttctcctatgaattaaatatatcttaatattgttcaaatgtttgattataatttttaaaattgtagcctaagctactattcttttttcttatttaactcgacgtaactaagtagcaagatattaaattggattatgacgatcttactttcggacaacccccacaagagcatcgcaaccaaccagcaaaacattattatgcgattttcaccactcagcattaaaaaagaattattaattacccaaagtataaataaagcaaacgttacgataccaaattttacaagaatagccatataagtattatccgcaaataaatacttaatagtcccgttcatcataataccatttgtgtcacctactagaggagttggttgtcccattaaatgtacaggataaaattgcttcacaatagaatttatgagttctggtcttccagataacaacttatttataataatccataagttaattgttggattatataaataagtacttagaatacttatggtagatacaaaaaataaaataactgctaataaaaatttaaatgttttcgaagagagcctcttcaaacttgtatatcttaacagcatatataacacaaaaaaagccaataaactcacaacaacagacctatcatttgttgtcttctccacaaacagaacaatcggtagtattgcccatattcgtactttagatttatttttagtatatcctaaataaataaattcaaaagttaagatcattatatacgcaccaaataaattcgggtgataaaaaccaaagctatgtcttactactccagctgctctgtaaatatcaagggacggaatatagtttaataacgataaaaaaacaatacataaggtagaaattaacctcacaaaaaaatctatttctacaatttttttaaattcaatattttttaaaagaattattgtaattaccgttatcactaaatcattagtcttattttgataagatacaaaagcactaaaaacaatagcacctaagaataataataattctttaaacgaatatttttgagaaaaaaaacctaaaaataacattagtaaagccacaattttgccaatgttaccaatgttaaccaagttaattgtttttgaaaattgggtataatatagaacggtgtatgtgagaataagcacaccataaccagcaagaccgatatttctaaaaacattcgaaattttcatgaataattagcacctcttttcttattacacaaactcaaactttttggagaattgttactacatgataattcttaaaatgtaccaactatacaaatcaacatattgttttttacagttagatttcaaaactactcttctctggaaaacattctgtgtacgttttcagtaacattttttttatcatatgtgcattcgttacattatcagtatcatttaaacaaatcattttatgcctacggtttataatttcatccttaatgcttttcatttcgacttttcctaaatcatatactcttccagattctgctcctcgtacactataattacctgaaacaagttgccagtacctcattagccactgattataatcgtatggagttctaaatttatttgatagagtttttcttaattcttcatcataagcatcccatacttctttaaaagtacttttgttataggatacaggcaagtgactattccaaatcccactgaaatttctattcggcagaagtgcaatggttcttaataatttcattctatttctaatattaaatactttaccaaaattattcttataaaattcaaatttattaaatttatcatttattatttctatgtcattaaccatagcatgcgccacacttccttttgtagaaatgattggactttcagcatataaatccttaggtattgttccatttttaaaaaaatagtttggcgccacaaaatcatttaaaaaggtgtcatcattaaataagacaaaattttcactcaactcatctatatttccgatgttcagctcaataacgtttgaattaaaagtgggcaaatatttttgctcaatataatcgctatggttcactagttttagtttcgaattattagtatttatccacttcggtatttgattatctgttattaaaaaaacactatttacccatggagcatatttttctacagctctaaaccaaaatcttaatgtatcataatctctatatctactttccgtattaattttttggtttatgtccatcttttgataactatttttcttagaaatccacttctcatcattatcatcaacccacgttatgacaaaatcaatctttttttccataactcctcctagtaaaaattatttatctcttaataacaaaaaaagtttgtataaatttatattcataaaaatcaaaattaatgcaatttttaattccaatttgcttttagtagtaaaaataactggagatgctatttttaataaattctttcttattttatttgaaactcccttatactgtttcgcatcctttgatctaagtaaattacttagagtactaactcctgcccaagcttttcgcaccttaacttctcgatttaaatctggaaaaacctctaaaactctttttgtcattatattagtacttgatatcaaatctagtgcactcattttaaattcggatctggttatagaatcttttcttattttgtagtggtattttgcttcgtttcctacggctactcccttagttttacttataatagtaggtatagcatacgtatcttcaaacaattttccttccggaaaagtatcatcattaaacaagtcagctttatataattttccccaaggagataaatctactttattcatcaaaagaacatcttgtaaccaatcatgtgagctcataaaacaactttgttcattaaaactcatatctatattttttttattattaaattcaacaatatgttggcacgaagaaatatctacattaaatttttgcaataaacccaagaggtattctagatagtctggctcaactacgtcatccgagtcaataaaggtaataaattctccggaactttccctaatgcctctatttctcgccgcagatatgcctaaatttttggtggttattatttttttgttttgtataaaattcatcttttctatatttttcaaagaattatcagtagagccgtcatttataataatcagttcaaaatttttataggtttgttttaaaatagatgataggcatccttcaatgtgcttttctacattgtagacgggaacaattatagatatgagattttgcttcaagttacttctcctcaattttttattttagaagtgtgttatttttttcttactatcttttatgaactttctttttataagatttagggcctttaacataatttttctttcgcctaattgaatccatttttcttcaacatattttttattattagcttcaatccaaacatccatcaatctttcagataaaaagccaaaaactcgagcatcttgaacagaatatccagaaatatcaattcgatcttcaaccttgaacaagacgtcaaataaccattctgaatattggttaaattctttcttcttcatgataaacatattaaacatatgcgcagatgttttatgcataacttgatcgaaagcattcaggtaacgcggatatttttccgcaatcacatctctagtgacatccaaaggttcttcaggatgcgcatgtacataatgtgaataattagattcaatgtaatactttcttttcttaggtaatacaattggtgcttcctctaataattgctcaatctgttctttattaagaatattatctaattctcttttaccgcctttactaaacaatcgacgataatgtactaaaccaatcgcatctgcatctaggtttttccatgcccaatataccgcagttagttcattaaaattaggattttttaaagaaatattttctcccacatcatctctttgataatcaattccttctttataatttttagttgcgcccactaatactggcagatacaaatttttattttccggcattggaaattctttatgagccgctaccataactttaattttcattattagtaagcacctttccctctaaaaatattgaataagttcataaacataatttttaagtcaaatccaatagaagcattatcaatatattccatctcgatttcagctcgttctggatagccaatttcactccgtccactcgcttgccataatcccattgcacccggttttactgacaatagtttttccgcatcatattcaactagttcagcttcaactactggtcacggtccaactaaactcatatcgccttttaagatattaatgaactgaggaatttcatcaatcgatgttttacgtaaaaaggcccctaccttcgtaattcgaggatcgtcagcaggttctaacttataattgttagcaacatatttagcatataattccttatcagcatgtaatttttcatcagcattaacaaccatcgatctaaacttgtacataccaaatttctcgccgtgatatcccattctaatttgtttataaaataaaggaccacggtcacttttatcagtttggttcataatccaaaccacaagaaaaactggactaagcacaattatggcaagtccagctaagataatatccatcactcttttagcacctaaatagtaagagctgtttatttttgactggggcattttattctcctttaaaataaccaaaatcttttctttttctttgccttcgtcgaagacacgtgcagaatgctttccgtcttaattgaatccccattcacaattgacttagcattatagttgaaaagttcggccttccgatctgtcgtttctttagttaatttattaaaagcgtcttgcattaaaaaacgccgtccttcaaaattgtgcgcatccgatgaaaagacaaagcctaaacgcgcatcaataattttttgcgttaattgctctaccctttctccaaacactcccagatagctgctactggtaagttgggttaagcaccccatctccacaaagtcgtatagccgatcgggatttttttgaaagccatgattgcgctctggatgggcaattaccggagtaattccccgagctagtaattcaaaaattaccgtttccgtatattctggaattccactgtgaggcaattctaataacaaatacttgcccccctcatccataaacaagatatcgtcattatcgattgcatctaatagttctcccgtcaaatgtacttcttgacctgggaaaaccgtcaaaggaattccggccgcatctagttcttgttggaaagccgccgttttacgaatcacgtctgctttgtggttcgtatacatgccgtccatatgatgcggagttaataaaatatgtgtaatgttttgtttaactgcttcacgagccatgtcgagtgccattggtaaatctttggcaccgtcgtcgacacctggcagtatatgacaatgtaaatcaattaaattcgtcattatttatcatccgtcccgtaataaccaccatagtaaccaccgtaataacctgttgatttttcagcggttgctcggtttaagattgcccctaaaatgttagcttggactgcttcaagtaattgcttagcatgacgtacacccgctttatcggcaattccttgagggacaaccaaaattgttccgtcggcgcgggctgctagaacttgggcgtcggttactgtattaacaggtggggcatcgatgattactaaatcataagctccagttaattggtctaagagagcagccatcttggtcgaacctaataattccgatggattaggtggaatcggtccacttggcattaccgaaagattattaatgattgtttcatggatggcattttccaagctgccagtctctgctagaaggttactcaaccccactgcattactaacactaaaggtacgatgcacagtaggacgacgcatatccgcatcgacaattaaaacgcgcttgccttgatccgcccaagtgactgccacgttgttacttacggtagactttccttccgatggtgcggatgaagtaaagacaattgatttcaacgccttatcaactgatgaaaattgaatgttagtccgtacggttctaaattgttctgcaatcgtggaggtcggatcagtaaaggtaactaatcccacactatttttaagactttcgttatctaacttttgtttcttcttaaacatttcgattacctatacccttctccgcattctggattgatcatcatcaccatcactcattggtgctctaagttttggtgtaattttacgacgaatatcagcctcattaatttcactaataatccctagacccttaagaccgagttcatcggttaggaattcttcagaggtaacggtccgatcactaaattcacgtaagaatgctaatccaattcctaagagtaaaccaactaccaaaccagctgcaatgttcaacttagttcttggactaaccggttggtcatccgcagtcgctttcgaaacaattgaaacattattaatactcataatcttaactactttgttcttaaaagttgtcgctgtttcattggccatcttagctgccgtattaggattggtgctcttagccgtaatggaaaaaacttgagagttttgttgactattaactgaaagtgattcctttaagctatccacatcgcccttttcatatcccggttgtccttctagcttggcattaacggtctttaaaaccgtgggactggtaataatgtctttatatgtactgatcatttgaacatcggcttgggtctgttgtaactgagctcctgccatgtcctcagacaatttacggttaaccaaaatttgagtcgtggcactgtactttggtgtcataacaaaaaaagtcataaaagcggctaacaaagttacgataaacgtactagcaaaaattaatccaatgtgtttacgtagtatcgataaaatctgaccgatactaatttgttgtgattctactgattccatgagttcctccaaggtttattttaggtagtcaaacatattttttgaaattgatgacaggttattttccccattgatgtagttactaaataggaatgttccggtttgttgcttgagattccattcgatacggttacgtccgccgcccacggcttgggtgaggctcaaggcatccccattaaccgcaaagccagctacatggccactagcctgaccgaagactttatctaaagtcgaactggaaacataatcactattaaataggtagttatacatctgagcgatatcggctggcgagctcaccaactggtcgctacctaagcggttgagttccgctgtatctaaagtggagttacttaccttcgatgctgaacctacatcatccacccggtagtaatcgacagtcttatttttcattccccaagcggtattcgagagctctaactgatcaatcaaatcactgacaaccgaatgatatgattcgccggaagctttttcgatgatggccgcttgtaagatggtattggctctagaatctgcaaacgttccttgcattgtcgaatcaaaggtagcattcgcattaacttctttgactaagctcttagtcttaccgctactggagatggtatctgctgtaatccctgaagcctgattcatcacatcggctaccttcacggattccgctcccgcgacttcgctgtcatattttgaaagcttatcgttgagcttaactttccctgtatcgattaaatgcatgataatcccagcattaatcgtatcttggatttttcccactaaaaattggctatccgccgtcatttcatccttagcagcatggttagcatagcctcgtgaactcgtaagaatcttcttacccgtcgctaaggctgctgagccgttgtattcaccattatttaaaatcgaatctaaattggaactcttagcaacttttaaagttgctgagtcttctactgaagaagatgtggtactagaactacttgaggaatcattactttttcccgtgtacttttcaatcatatgtgtagcaagtgagtccttattgaccaaggttacaccgaaccctgcaccagcaaaaacggctaacgaaccaaccgccactcctaaccacgttagtgtttttttcatacagtatctctccatttttaataagtcacaattaaatctatcatttaatttataaattttcaacgctttaacccgaaaacgggctttgttatcgggcatttactccatattgtaatattgccgtaatgttttgtaacaaaataaaagagctcctaatttgcattagtagctcttacttagtttctccataaattgattttaaaccagcaagatcggctggcgataaagccgtttgttcgcgatccaatgggtacatgaccgaatcctcttcttggctatgatccaagcccaaggcatgcccgacttcatgggtggcgacggcttgtgaaatggctttgttgtagtaaatgttgagtttagcagacgcatggttggcgattcgactaactacgcccgtttgttccataattttcggtccaccaatccctagttcaatcgtgcgagattggtttagcggtacatttttacgataggttcccagttctaaatgatttagccagccttgttccgctcccggaacaattctaacaatccccgtggcattgtaagtcgcaatggcgcgcttaaaaacgttctgaaccgcatccggagttcccgcttgataactatagtagtatttattcgataaatttttgtttttgacaatcgattccaccggtgttgcgtcatcgctgacatcctttttagtcgacgtcttgttctgattaaaattccagtttgaatctaaaatcgaatttaagttagtcgtcacccgactaactccgtttcgaaatgtctgttgcacattatctggtatctggactatgttatttttaatgacccacgttgctcccaagaaaagcaacaaccaggttagcagtgttctgattcgcaagtagcattctcctcactcattggcagtagcaacattttatacctatccttataaattctaacaaaaaaagctcagcactttaacaaatactaagcttcttgataatttcgtaaaatttggaagaactgatcgccatatttttggagtttgctttccccgattcctttcacgtctaacatttcatcgagcgtgtctggcatgactgtacacatatcgtgcaaagtttgatcagaaaagatgacaaacggtggaacgttttgcttttcagctagttcccgacggagcgcccgcaattcttcaaacaacgcgtcgttttctggtaaggacttattcgccttaactgccactttccgagccactttttgctgacctaaaaggacgcgcaagccttcctcggtgattttcaagacggggaactggccgccgtctggggcgatgtatccagccgccgtgagaaaatcgattaattcggtcacgctctttttggtccgctgctgcattaaaccatatgtcgacaacttttcgtagtgcagctgttttacccgctgatttttcgaacccgtcagtacgagggcgaccatttcttttccaaaccgttcccccattcggcggatacaagataacacttgctgagcttcaatcgtcacgtcttgtagagctcgcgtatccaaacaattgctacattgcccgcagtctggagcatcctcattgaagtaatttagaatgtagcgctgtaaacacttttgcgtattaccatactgactcatcgcctgtagcttttggtattccatcgtcatgctggcttcgtctcgttcagattgttcgatatagtagtgctgaatctgaacgtcgcgcaatttgtataacaagatggcttcactcggtagaccgtctcgccccgcacgccccgcttcttgatagtaggattcgatactgcccggaatctgatcgtggatgacaaagcgcacgttactcttatcaatccccatcccaaacgcgttggttgcaatcataactagcactcgatcatacagaaagtcgtcttgattttgccgacgttcttctttcgaaagttgtccatgatacatggccacttggaaatgctttttagttaaaaggcgatggaggcgttcgacctctttcacggtgctggcgtagataatgcccgattgatctggattcaattttaagtagtcgatcaaaaaacggtcgctgtcttgatccttgacgactttaaacgaaagattaggtcgggtaaatccagtttgaacttcctgttggatggctaggcgttgcttaatatcctcagctactcggggtgttgccgtagcggtaagagcgataatcgtgggtcgagtcggaagatgatggatgatatccgttaattttagatagctcggtcgaaaatcatgcccccactgtgaaatacagtgggcttcatcgatggcaatcaaatcaatcggtagttctgctaaacgatcaaagtattcggaatcgaggcgttctggtgaaatataaagcagcttcaccgcaccctggcgtgcttggccaaaccgctcgttgatttccgcataatctaaggagctattgatgaaggtggcgtcaattccgttggctgctagagcatcaacttgatctttcatcaaagaaatcaaaggcgaaataactaaggttagtcccgcctgcatcaaggctggaatttgataacacagtgatttccctccgcccgttggcatgacggccaaaacgttttggtggtccaaaactgcgttgatggcttgctcctgccctggtcgaaatgcatcatatccaaaatttgatttcaaaactgcctgtggattcatgtaattcctcttcttctctctgggttgttaatgacgggtaaataataaaaggagtctgacaattaagtcacctcctcttaaattcgtcacctatttacttttatactaacacgcttggcctaatttttatatttccaatctttttgatagtatgcttgttcccaaaattcatactctagttcgcaacttcgcaagaaacgttgttcgatttcatgttggcgttcctcactgagacctattgctaattcgtcaaccataccaaataaagtttttaccatgctgtcatcaatttgacctggttggggttgataaaattcaatccatggtaagaagggattatctggtgctgctccgtccacaatttgctgactaatttcagtatacgtccaaggacaaggtaacattgccgcaattaagtcgattaaatctcccgttcgtaaagcgttaaaaagatgctcattatataggtaggtaattggtcgctgttcggcatgttgatggtcgctgagcttttgaccagcgatgtcacataggatttgatgtgcaccagcttcgtcatttaaagtgtagcgaatctgttcctcaaaaaagcgcatctggtctttagtagtacatttggaaagagcgcctgcatagactttggcgaaggcatctaaaaaacaggtatcctgttcaacgtagaccattaaggccgctaccggaacggcgcccgcttgaattcctcgcacgaatggatgattttcaatatcggcgaggacgggttgagcaattgcttttaaacgtgctgaaaacatagctttcctcctcatcccttaacgatcgctttaattttttgcatttgagtgggcactgccgtcatctgcgtaaacatactaatggccgcaaagcctttgactcccgtagccatcgtctgggggagattatcaagcgtgatacccccgatggcgacgattggatagcgactcagttcgacgagttcttggagtttggctacaccgagtgcggctcccgcgtcggctttagaggtcgttttaaagaccgtcccggttcccagataatcaattccattgagttggttagcctgtttgacttgcgcttcggtgttacaagataacccgacaatcatcgaaccctgaacccgttttaaaactgattcaattttttcatctttttgacccacgtgaatgccttcagcatgaatggctaaagctaagtccacgtcatcatcaatgaacaacggtacgtgatacttttgggttaactgatggcatttttcagccagttcggttaattcagccggattatcgatactgttataacccttttcccgtagttgaaaggccgttgccccggcttgtaagatttcttccactttaggtaagaagtccgccttattagcaacatcttgggtgccggccacaaaataaatttttaacatatctgaattgaatttcattgttcttcctcgccataagcccaatggttcaagggaccatgtccatggccaacttgaatcccatcactaatcgccgcattgataaatgctttaccggtgcgcaaggctgctttcaaagatgctcccttggctagttcggcaacaatcacggaagaaatcgtgtcgcctgtgccatgggtattgttcgtttcaaaacggggtcccgtcaattccatttcttcgccattttcaaataggacgtaatctcgactttcaggttgatcactaaaatgaccgcccttaattaagacgtttttaactccgagttgttgaagacgacgagcagcctcctttacatcgtcattatttttgatttccatcccagctagtttttctgcttccggtaagttgggggtgatcaagtaagccagcggtgcgagttggctacgcacggcatcaatcgcatcatcactcaggagctttgcgccccccttagcaatcatgacgggatcgacgacgagtggtccaaagtcgtatttttgatagttttccaccacggcgtttaccaccgcggtgttagcaagcatgccagtcttggctaccttgatatctagatcttccgccaaggctttaaattgttggtcaatcattcgtttgggcataacttctacatcaagcacgcctaacgtgttttgagcggtaacggccaccaccacacaggtcgaaaaaacatgacgctcctgcatcgtcttcatatcggcttgaatgccggcgcccccaccactatcggtgccggcgatggttaaaacttgaggtactaatttacttttcatgatttatgcttctccaattttcataaggtcttgaacttgttcaggggtgatattagctaattcgtctaaaagataggacaaaaaactacctggtcgattttgttgatcgagttgcgccgctgcgcgttctcccgcacatgagagtaccaaactagcggtaacagcagcatctaaagtattttcagctacggcgctgaacgctcctacgatactggataataaatcgccggagcccacgatggctggtaacaacttagtgttattgtgcaccatgatcacttgttgaccgtcgctgatataatcgacttcaccactagcaatcaccacgttgttaaatttctgggcacaagcttggacaactgcgctcatgtcgccggtcccatttccagcgtcgatgccgcgcgtttgccagtcgataccggctaaaacggcgatttctccgatatttccacgaatcacatcgaaatgatatttttctagtaacatcaaattgagggctttgcggtactgggtggcaccgactgcgacgggatctaagacgagtggtttttgatattgattagctgcttcacacagcttattcatcagtggccagctctctttacgagaagcgcccgcattaatcaccacggccgatgcgagttgaacgagttcctccgcttcactgacttcatcactcatgatgggagaagctcccaccgcatttaagccattcgccaccaaaaatggggtaacaaaattagcataattaactactaccggattaacttcccggattttggcaatatcttgaaggttcataataagctccttaccaatatctatcactgcccttaatgtcgaaaaaaccacccttttgtagacagaaggatggttttggtttcaacaattaaacacttcccttcgcaagtactaacttacaggttcaaagggatcacgctgaacaagcgtatctcagttcttctaagaacacccctagtgcagatatttattaaattttgaattcggtttcatgatacaactttttgtccatcgactcaagttgagcatatcattactactttagatggtggacttgctacaatggagatgaaccaaaaaacttaacttttaggaggtattgttttatgtctgataacgaaagattggaaaatactaaagatagagttacaggtaaagttcgtgaaggtgccggcaaagtaactggcgacaaaaaagaagaaactaaaggtaaagctcaaaatatgactggtaaagtcaaagataagcttaaagacgtcaaggaatcagctgaaggcgccatggaagaactcaaagataaaatgcataaagacgacaaataaaaagaaggttcgcttaacggcgagccttcttttgggttaaaaaactattttcgttttagctttttgaatataatccagccaacgccaattacgatgagcgcaattactgccagtccgatgaataaggccgaatgattttgaatctgatggcgcttagcgaccttcaaatcagctggcttaatcttgaagttcttctcaaatttccaatgatcttttccatgttgcatggtcaaaacaagcttgtattgacctgctttgatatttttaggtacttggataggattctcaaaagttgtttcaggcgtaatgtcaatccgcttagtttcctttttgagggttttattatccatgtttttgatggtcgaaaccgttttgacactcttaagtaaattttgatgatggttggtaagctttgcatctaattcgtaagtactcaagttaggtttagtcatcttcaattgatctagagataaccgtggtgtgggtcgttgatcatggttcccgcggattacgaacggaatgttataagcaatcgtgttagaaactgtatttttctttactgctgtcgttttttccgtaaaatgtaatccagccatcaaaattccattgaaatctttagcaggaaaactaatgctgccatgaataacttggctactgttgggagcaacttcgacttctttaggcaacctaatcatttgagttaatttgtaaaccgtattagctttttccggagtacgatcagaatagtcaacaataccgttacgattagtccgagctttgttcacttcaatttcaaattgcttggtctttttagtattatttgtgattttaataccaaatgattccttactagctggtggccatttgatgtcaaaatagctatcggctccatccgtctgatgttccgaaaaaatgggtatcactgaataactagcaagtttataatcagcatgtacattcgtcgcagttagaatgctgattacaaatataaataccaacgtgaatatttttttcatatcgatctcttttcaaaaaaagaagagagaactaagtctctcctcggaataatggtgctattctgtaatttgttctgtttgagtcttagttaaattccattgaatagcagtgctataatcctttacttcttttattccattatattcaaggcttacagataatttatcagcgttttccccgacgatattagaatctttagatgctactacggctgcagcatcagaaagtgtcgtgtcaccaatttttaccgtacgagttgcatctgtgtcacctaatttagcagatagttggtatcctttagtatctccagaataatctgtaactttatagttaacatcttgagaaccaaagtttacatctccacttaaaggttgtggatcaaaattgattgcagaatcaatgtctaacgtgacatcacctttagtaactgtagcagttgcggttgtattcccggttagcttatcagctgcatgagctacaccactattggcaacacctaataacataccaccacataacattgcacttaaaataattttcttcatcttaataccccttttttttaatctgcttccccgatactacaactaatctaatcatcaataattcaaatgttactaatgactttcatttatatattgtgaatattttcataatatataaaagtcttgtttttatgtaaactttttagcctcctctattttggattaatactataattcttaattaagggcgcctttagggatattgacatactgaatcccagcattcagtatgtataaaaacgcataaagatagataagtgatggctaatgctatctatcttcacaagcattatattatacacgtttagttaaatacaagctctttttttaaaaatcgagtatttttggagattcgtctttaaggaccgcttttcccttcttaaccagccatattaattgggttttaaatcgttcccccatataattaagttaagctaattcaacttaattaacggaggtgcactatgaatttagttcaagctttcttgctatcatttaccgcctttttcgcaattatgaacccttttgctaacttacccatgtttgtgagtttgactgctgataatagtagacaagaagtcaatgccattgcgcgcttagccttcatcgttgcgaccgtgattgtggcactttttgcactactaggtaattacatttttagtatctttggtattaatctttcagctttacggattatgggtggaatcattctaggtttgattggttatcacatgatccaagggaacgtgtcccctattcagcatgatcccaagcaatcggttaaggattccattaacagtaataatactgacgtagcgatttctccactggctatgccggtgctggctggtcctggaaccatcgccactactatgaacttgtcgagtagtaccaaccccttcatcgtgattagtgcttttgtcgttctatcggtcattacttatttcatttttatctacggggaacaaattatggctaaattgggtaataacattatgaacgtgattacgaagttgatgggattgattctggcaacaattggagtgcggatgttaattatgggggtgcaggtggcgtttcattggtaggaaaattttccaaataaaaaagcatccaatctgtgattgggtgcttttcgttttaacgattaaattagaaactagcatttcctggtgtacgagggaatggaattacatcgcggatgttttcgattccggttacgtacataagtaatctttcgaatccaattccgaaaccagaatgttcagtttcaccgtattttcttagttcagcgtaccattcgtattccttaggatcgagatggaattcggcaatcttttcgttgatcttgtcgagacgttcttcacgttgactaccaccgattaattcaccgataccaggaaccaaaaggtcaacggcagctacagtcttgtggtcttcattttcacgcatgtagaaggccttaatgtccttaggataatccgtgataaagacgggtttttgatataccttttcacttaagtatctttcgtgttcagtttgtaaatcaatgccccattcgacttgattttcaaactcttgatcagcattcattaagatgtcgatggcttctgtgtatgaaactcgggcaaagtcagcatccttagtagcttccaaacgggcttttaattctggatcaacggcaccgttcaagaattccaattcttctttagcattttccaaaagatagttaactacatacttcaacaaatcttcagaagtattcataatatcttgaaggttagcaaaggccatttctggttcaatcatccagaattctgaagcatgacgcgtagtatgtgagttttcagctctaaaagctgggccgaatgtataaacatttctaaaagccaaagcaaaagcttctgcattcaattgtccactaacagttaagttggtaggttgtttgaagaagtccttgcttgaatctacttccccagcttcgttcttaggtaagttgttcaaatctagcgttgttaccttgaacatttcaccggcaccttcagtatcactgctggtgatgatcggtgtgttaacgtaaacaaagttgttgctttgtaagaattgatgaacagcaaaagaaaccaatgaacgaatccggaaaacagcatagaaagtgtttgtccgaggacgtaaatgagcttgttcccgcaagaattcaggagtatgttccttcttttgcaatgggtagtcactgtttgagctacctaaaattgtgattgaactagcttgaatttcaaatggttgcttagccttaggtgtatcagccactttacccacaactttgattgtagaataaattgctgccttacgaatttcttcagagttttcaagggcattgttgtccatgataacctgaacattcttgatgtaagaaccatcgttaatttctaaaaagctgattttctttgaagaacggatggtttttaaccagccagttacttccacttctacgtcagcatcatgttctgcttgagagtagagtgttttaactaatgtgttttccatgaataaatcctccattcttatcctcgtaaaaagtccggtacaaataaaaaagtcctcctccccagaagggacgaaggactttcgcggtaccacccaaaattcgtttaattaaattaaacatcttaaaataagcatcgaaatgctttccaagctataacgggccggccccgtctaagcctactgtaatttcagcttagaaacaaagaagatgtttttcttaaaagaataactttttgagctcgcactatcctcaattcgctttaagttatgggctttaaatactcgttcttcttacggttgataattatatctacttctcgttagattagcatataaattcagttttgtaaatttcaaattgcacttttactcgataaatttatttgaagcaggatggagtttttgataatgatcatataaggccggatctgatctctgagtacctggtttaaaattaactgattccgttttagcggctttagcccgggcgtaataccacttcttccatcttaagaacgcgagctgcgtttctaattctttaatttggcgttccaaggccgcttctcgtttaaccataaagtcatagcgttgttctaaggtttgatctccttgcatacaccactcgatgaattggccaatttctttaacaggcaccgccgattttttcaggcagttaatcacttccacgtatcctaaatcatcttccgtgaaaattcgcctacccgcttcatttcttttagcaaaaggtaatagcccttctttatcgtaataacgtaaagtatcggttgttacattcatttttttagcaatatcgccaattaaatatgttttcatttttaaaatttctccttgacttggagttaactccaagtagtaacatcaaatatatcataaaacaaaggtaggtacataatatgaataaaccattaattgttattactggtgctagctctggttttggagcagaaatagccaaaatttttaatcaggcaggttaccctgaattattactaggtcgccgagttgaaaagattcatgctttaccgcttaactttgaaaacgtcatgattgaaagcgtcgatgtaacagatcaagctcaatttaaaaaagctattgagcatgctgaagctaaatttggaccagttgacttactcgttaacaacgctggggtaatgctattaggcaacgtgactacccaaagcccaaccgagtggcaaaccatgttggatactaatgttatgggcgttttaaatggaacccaaattgttttacccagcatgttagagcgtgaacatggaaccatcattaatatgtcatccctagccggtaagaagaccttcgttaaccatgcggcttatgttgcttctaaattcggtgttcatggacttagcgaaactatccgagaagaagtttctggtaaaaatgtccgaatctcaatggttgccccaggcgctgctgaaactgaactcctcacccacgttactgaccaaaatgccttggtcgattatggcgaatggaaaaagagtatgggtggtatcactatggatcccaaacatgttgctgaaagtgttaagttcatttatgacatgccacaagcggttaacatccgtgaattagcaatcgcagccactcgtcaagatagttaaataaaagaggtcatcgcattaaaagcgacggcctcttttatttttcaattctgggtgactctggaatagcgccgttagttcggcctgcatttcaggattattgcggccttttccacgatatttacgcataatttcacgttgcattagacgtaattcacgaagactactacctgacgtctctaagaactgttccttttcatttttaggtaactgtgcgacatcttgtaagtccgtataatcatggcgtgtcgtcacaaaagaaataacgggcatcgctaagtaaacgaccaccatcgctttagggaaaaagtacgctaaaaccaagatggtaatactggcataacccaaaaagttattatgattaccgtagaccttatgaaaaatacgtttaatatcttgttgatcggtatatttttgtttgatgaccgcatagctaagccttacaaacaatccattaacaataatatttaaaattccataggctaaaaccgttgtccgattggtatcgtaagtaataatttttgtaaaaattggcatcaaacttaagaaagctaaaaaatgaattcccgaataaaaatatgatcattcattgtttttgcatcattaaataacatagaatgttggtaccaaatatttgctacaaaacaaaaactaataaaaaagattccaactgctttaccaaattgcatatattcgctaaataaatcatgcttggggattggcaattccaataccataattgtaatgataatcgcaatgaccgcgtcactaaacgcatccatgcgttcttttagtttttccattaaaattcctcggttctattcgattcgttttccattaataatcaccgtatcaatgtgcttagaaacgcgctctttttctggtggcagctgcatgtaatcaccatacatccgtttcaaaatacggtcgtagtgttggggaatcgaaacctcaatggattcaaacttatgcgtggttagttctgttaattcggactgacttaaaacttctttatcataggcgtactgagaagcataatttttataatgatgaaatggctcattatcatacaggcgcatgatattttcacgtcgctcttttaacttggctacactcatgaacaactctaaaggcttctcgttaggcgctttacggaacggtgttttgataatgttgtaccctagtcgcacgagaattgcggcgtcattaatcttaaagcgattgtagactgcctggcgaatttcaggttgacgaggaaccttatcaaaaggaaaaatatcaataaaaattcccttgtgggcatcattaacattattcttttcttctatataagtattggtatctaaaaccttcatataactaaatgcaaaattgggatccgtatccgccgtttgcataaagtaatgtgtattttggaactcaactggcgcgaccctagcgaactcatcgtaattttcacgcgtcatccctagatcgacatcatcatcccatggaataaatccgtcgtgccggatcgcccccagtaatgttccaccgattagcatgtatttaatatcatgtttatcgcaaatttcgataataacttttaacatctcaatctcgactcgatgaatttcatcaatctggctcatggctctcctcctcttttcctagttacttaaattgtgacatttaaggaatagttaagcaataggcaaaactgtttgactttcttgaatcatgtattatgatgagtgcatatagaaggaggaatttctcatgaaaaaaactaaaaatgctttgctggattaccttttaaagaacctccaaaattcagaattgcttgaccgtcttttaaacaatctccaaggtcaacaacagttagcttatcgaccaattccgattgaaaacgataaaaatcgccgttaaaacctggcatcctatgatataatagatcataggttctattttggggtcgttatggattcgacaggtatgggtcgagccatgactgcatttcgtaggttacggctacgtaaaaacgttcagtttattataactgcaaaaaataataacaattcttacgctttagctgcctaatagtagcttaacgtagatccgcctagtctcgtccatgggctagatacgggtcctaaatgaagtggacttgcgcttaagtactggcctgggtgcttaagaagaggatttacagactagcgttttaatgaagccccgacatacggcgtcttatttcgcgaaatttaagtagtatgaatatgaatgtagatgtcatggtggcgacatgcttggacgcgggttcgactcccgccgactccatttttgctattccttcccgttgtatacagcgttaaaacgttgatatgacgggatttttttgtacttctaaatattcatgttttgcttaaaattgcacagaattgacctaaaacttagccaaaagcttagccaatttttttggtacttattcctattatggcaaggtttaaagcacttattttttacaaaaaattctataaagcttagccaattttagttatttggcctcaacgtaatcttcaaacctctgcaaagctgctacattctgttgttctgtcgtatgagtgtacacgtcgagcgtaacgctactgtctgctcttgagtgtcccaatctctgttgagtctccttaagacctactccagactgatacagtagtgaggcgtgtgtgtgcctaaacccgtgaattgagatgtgtttgagtcccgtggctttaatagctttattaagccatttggtgggggtattcatggagcgaaaatgatttctattgctagcaaatactaactgatcaacattgttagtattgaagcccatccccagaaaagtctcgcgttgaacacccttccattgcctgaggtatcgcatggtactgtcatccaagtcgattgtacggcgtccagccctactcttcggaggttgtacgattagcttcccacctaatccctgcgttagggtcttattgacccgcaacgtattgtcctcaaagttgatatccttccacgttagcgctagtaattccccttttctgataccagaataagccaacaccctgaacatcgtgaattgttctacgtctctttcgggagtcacgtaatcgaaaaaggtattcagttcgtctctggtccagaagttttctaacttttcgcctgcctgttcctgtactcgtggcattgttactagcgtgcaaggattccgccccacgtactcagccctaagcgcgtaatcaaaaatcatcgaagcgtaattcagccatttcttataggattttgcttccagaaaccacttattaacaaccctctggcacacgttgggtgtgacttgatcaataagcatatccccaaaagctggtagaacatggacgcgaataatacgttgagtcttctctagcgttgactcacgtacggtcaaacggtactgttccatccactccgcgcaaacgtccctgaaaaagcgtctctcatcctcctgtagtcctcttttttcgatttccaattctaatctactcaatacgatggaggcctctttcctcgtcttaaagccacgtcttctcgtggtcttttggcgtcccgttagaggatcaacccctgcatatacttgaaattcatatctaatttttcctgtttttgttgtgtattttttaatttttgccatttttattttcgctcctgtgttgcttgcgaggctcacatttttcgaaaatattgggataacctcccgtgttgcagagtcgaacccgcaacagctacatgttacattgaaatctttgtttaggcaactcaaaaaataaatttaagagatttcacaatttgtttgtgagatttctttttttatacatattatctgcagagacacagaaatgtatctgattggtgttttttttttttgcgtttttagtcgagaaaaaaattttaccctatgttatctatgtaaggtaaattttattagatttttttagtaaaacactacatttttaccccatgttataagtgtacggaatcaaatggaattgtatctaattgatgctttttttatgtctttttggcatattctctttttttatccatattagtagtgtgaaggtattttttaatattttttacttgaaactcttttcacaccctatataaggcgcatcatacatagtcacgcaatagtggcttaaaaattaactggaggtttgcagatggaattaaaacaaataactgacaataaggaattaatggaacaactctctcttatgtttagcccaacacctcgatacatgaataaaaaggaggcatgcaagtacatgggaatatgttacagaactttccagaaggctattgccgaaggattgcccgccgtgcagattggaggtgttctacgctttgaccgtttagtcatcgatgaatacctgaagaataaaatcatttaattaataaaaaatacgcttgcgaggcttatttaagaataaaaattatttaactaagtataaaaaaatttaaggagtaaatattatgagagacgcacttaagcaaataggaaataaagaacgcggaacatatgtgggagttgttagcagactgggttataagactggatacaacgggcatggcaagcctacctttttgataataaatttaacggatattaatggaaatctagtagctgatcatctgtggattaattacactaaacaatttcaaagtttgggtattttggctacaggtgatgaagttcaattcaatgctaagatgtctagttatctcaagggttatcaagggaatgactccaccataagaaaaaaacatcctattcaatatgactataaattagaatatccttctaaagttagattactaaccaaaagaaagcctcaatcagtaccagaaaccaattgggaattcctccaatatatattataggaaaataaagacttctatcttaaaagggctaaaaatagccaataaaatgaatattttataccatacagaccccttacaaacgttgatatgacggcattcttggattttaaagctatctaaatgctaaataatcggaggaattaacatgtataacgaaagagaacacttcacaggaacagttataggtttcaacatctacaccaatgataatgataccaagcaaagaccggtagtctatttaagaaatgtaagtggaagcaagcataagtttgactttgctactgtaacctacactaagaatatgcgggataatatcggaatgctcaccaaatatgactggatagagtttgacgctcgaattaaattaattaatggtgtcatccccctaaagccagagttgttaaacccgactaaggcaggacttttgagaccttcacgtagttgtaaacatatctcagaaggcaaagcatttaacatgattaataactatttaaaatatcgtacggcatagacataataattagatagcttctggagttattcacatgcgggctttgcatgtggataacataactagtagttatatgtattagagttgtgaatcactacggtattaaattaatgataatgatgtagtcccaattcaggattatacgttaattattctagtaattattaagttagctactagtgttctaagtcttttcattttgaagcccgcaaaacaaaaagattgtccaaattccattctggaattgtgcccaataactgtaaatccttgacggtagaacagtcacttactttatatataagaattgagtgttttaccgtgaagcaattatatatatccagtaataataaattgacttctgcgggaattttgccaacggcaacaattaacgcagatattgtttgcggcctgtgcaaataatatcaggaaataactagtagttaaccgtattaacaacttaaattaattaaaaaatggtacaggtcttatataaggtatctagcaaattttaacgaaaaaaacaaaatagaggtgtgtgtatgagcaacggaaccgtgaagatgttcttgtgtgtaggtaacgcaggaacaggaaaaacaacggctataaatgatgtattaagtgatattggtaataatgatgtatttctaaccacgcctaataaaacagccagtagcagattgcaaggcagtattaaacatgtaaacaagttgttaaaagtaaaggttaactttggtagctatagcactaataaagcaagcaatataattattgatgaatttggtaaaatggcaagcattacctttgaatccttactaatgcatgttaataaccaaaaagaatcaggacaagatgttaatatttattgttacggagatagccaccagcaaccagcaatcaataaattaggtgctttggatgccctctggatgaaaaatgaacacaacaaacaaatatttgatgataatgatgaaaagaattttaatggtttgatgaaacaactatataagaatataaaagatggtacatttcttgatgtagttgatgactggaaaatttatattgatagtattcaggttagagtattaagaaaaaattatcgaatggatgccgttactagttggaatgctacagattttaataatgaattttatcaggaattaagaaataaacattcatttaacaataattatcaaatgcacttaaagcaatgtttcagtgatgggtggatgataataagccctgattataaaagaatcagagaagccaatgatgagttagaagatggaaatataattccagttgaagattttccctttgtatcaccaaaaaagaaagactctgaaatttatcttaatccatttaacaagcatttagaaagattgaaaaatactatcccagatattccaactattgttaaagaatctgttaatcccgactattggaattttatgtgtggaagcgtgacagataacatacaaggcatggaattcgataaagtatgtttctatatgggaaaccgaccaattccccctcaaagtcacgatttctacacaattaataaccttcatactggattaacgcgaggtaaaaaagattggatgtatataggtaaattaagttattttgaccaattattaaatacgcctcgtagggatgcatgggaacaattagaattagataataataatagagcactggaagaagttgtgaagcatgcagcaaaagaatattttggtagtctggatgttaatccatatagtgaatttaaagaaattttgaataaatggaatattaaaaaaggtatttggagtgaatcaacctttgcaaaaaaattaaaaggaaaaatcaaagaggataaattagatattccactgtatttagattgggctacgaatattactaataaatctaaacaagttggtaactctttgggcggtcaaaatagcactggtaaaggcaagaaccaaagtatatataataatttatcagatgaattaaagcaacaattaccgaaagatagaagcgatagaactattgcagacaaggatttttcaaaaaagtatggaatgacaaaagagcaatctagaaaattaaataattaattgctaatggtggcagatttttaaccaccatacatacagcctaattcggtaaattgccgagtcaggtttttgccacttttggcagaataatatatttaaccgtggaaaatatttttaacaagaaaagtcgatgtggtaccttgtgtatatatttgaggttgcgtggcattaacagaattttcatctttttttctaaatcaccccccgccctattaaatcagcatttcaagccgtacaaatttcaaatcatcgtattttttatgttcttgtttccctcaatctcttcggacccaccttaccacattaatattcataataatgtataattatccaatgtatgcataataaaaaaagccttgattataatcaatcagagccaccacttttatatttttcgtttcatttttcatttgatttttgaagcttgaaaagtctcacactgtccaaactgtcacactcttataggcaaataacatcagcatagacaaccattaacatacgtatcacatcatcacctaacccaccatataggcacactagacaaccataccaacgccatggctaagcatagaccgacagcaccaagctatgccacaaggatagcgtgaatcacctcgaagccatcatgatagaggtagacctcaagcatagagccacaccatagcaagcacaagcatagatagacacacgcacgtaaccaacaacaccacggacaccgtagacaccactaaccacacactatacaaccacgctacaccagcaccacgtaggcagccacacagaccgccatctcccagtcttgcacacatcaaatacaacggcacaccacaacagagctatataccagcacaatagagcttacatgcttgtccattacatatctatacaaaggcatttcatttacacaagattcttgacgttacctatagagtataaggtcattctttataggcgctagatataggacatttggtttccctgtttttatatcgtgaataaaggcattctgtttaacagagccatccgaagcaaagacatctgacatctttaatttcattacatcgctaactcttagaagagtggcttttcctaactggaagatcgtgtagtttcgtctaccggcctgaaaattattaagtaaggtgttttgtacctgagttaaaacattagagtctttgatgggtaatactagttgtcgcatagactgtaaacctccatttaagagtgccatagtacgtagttatttaaattagtctgttacataagtcaccgtatacttgcacgataacgccaggagcatcgggaacgtattgaatgttaatttttaaattaaaaatggcttgtctaggtgctaatgagtctgtaaatgtttgtaatatttgatcggtggctttctcaacattgcctaaaccactaattaagttgtatcccatcaaattattttctttatgtaaaaaacctatatattcatatcctacgggtattggattcgcactgataacagtattatcagcagaaaacattatttttgtaagtgttgattgatcaggttgttttccttgctgaagttgtgattcttcctcgttggaggttcctgtaagtgtcttaactttagcttcatgctccaagttttttctctcggctaaccctttttgcaggactttggctttatctatacatgttgtcaacaggggtattatttgattggtcataaaatctgaatcttgttgagtgttagtatacatttttaattcgttatctgattgactaattcgtatacaaattcctttggaggtttcttccgaacgaataatatcactctcaccaaactcaaaggtagactgaacaccaccataatatccggaaactatgtatgcatttgtaattacgtagatgtcatctttgagaaaaccatgctgttcattaacaaatacacctagtatacgtagttcgtcataaaactcatctatatctgaatagtctttaagcgtattttctatattttgatttgggtctttctcaagaagtttagagtttaaagcagtcgctaattttagagcttcatcaggatcgacattggtaataattgacatgaaggatcgcctctttctgtgtgggctataatttcgttatacataataataacccctatcattctcagtataaatgataggggctgttttaatagacttttcgaggggtcattagatcatttatagacccttttatctgtaattatagaaatatgctaccgggacttatcatagccgaaccctattttgaacttaattgggggccaaattagcccatattaagggtttaaagccgaaacatagttaatgacattaatacgaactaaatacgttcagaaaggttcatagtttttttctttatttttggtgcttgtcgaaataattgagtagcgcaattaaaaacgtgtcaaacagtaacgagagtatttggtagatgctcattgactatgaaaccttcctgtttgatctattatacagtggaagctagagatcaaaggtctctaaccaaatattagttttgatttaatatccaattattagcttgaacaattggattattagtttgcacgtcaggtttaattttattattgaagagtacttgcccattatttttcttgatttttgaagtagttatgtttacttgagcaccattgtacataatgtacgtatcgttgatactggtatacccagcagagttaccgccataagttttaacgttgggattggtttcaagtgctaaagccgttaactcgcctgaactagcagtccatcgattgagtatcaccgcaacaggaattcctgtgattttttttaccttgccgaggtctatcttagttcccatgttgttagtaacactcccttggaaggtcacactcgtaggcttgtttgccgcattaactacttcaaataattttccattagggacaactggcgaaattccagctaacattgggccaatgtcaccacctaggttattcctaagatcaatgataatacccttatatgttttactagtcagcttataataaattgtgtttgcgtatcttttcccttgtgatgatgatccattgaattctggtaagtggacgtataagatattatttttaacgctgctagttggtgctttgtattgtgaaacttctttttttacttccgatggagtcatcaaagaagcgtgtttaccactcttaattgccaaggcttgttttaacagtgggtaaatttctttgtaagtatgctgatttgaaatatcattacgaattttttttagcctatttttctgcgcttgattagctatataaatccctgtagacgatattctattaaaagccagcatagcgtctcttttaggggttggtgggactaagtagaagttgaagttaggtccgtattgatatcctacgtatatacctccagaaataatcactagcaaagatactattaacgatatcattacttttttgtattttttttaaattgcattttttaatcctcaagatactaccataacgaatctaatacgaaaatctgaaaaatcatcgatggtcagtatatcgtttagtttaatcataatttcaatacgtctatacaaacattttttgtaagagtccttttttctgttccttgagtaaatctaacttacgttgatgaagagcgatagtgtcgtctatactttggaaaaatgcccctattttttgttgttctgaaagtttggacggtacatgaatttcaatatttgataaatcacttgaattaatcgctggataactagtccctgtacttctatctaaaacatgttgaacaaattgcttgttttgaacactatttaataaaaaatagctatcaatgttaggacgcatttgagcataaccagttgagaaaacatagttatcataaggcaaatcatataaatagttattcatttgatatgggcgaaccgtctgataaaacacatcgcctttttgtgcaagacgctgtgcccttgaaggtgcttgatctttagattcagttctatgcgagatcatttcagtccctacaacactttctaagtctacatactcaaattcatctggaagaactgttttaggattaaattgagctatatcttttaacttacgcttttcccaatcgtcagcaaaccccacaaatcgcaattcaggaactttggccccatttttagggaacattttttgcaagtagccttttttctgttccttgagtagatctaacttacgttgatgaagagcgatagtggcatctaactgtttgaagaatgaaccgatcttttgttgttcttcctgactaggtttatagatttcaaatgatgaaaatttagaaatccaatgacgttcatgactttgaggtacatattttatattcttcaatgtattaaacataaaatagaaattgtcagaattatcattcaaactaagtaatttcattgcggagctcttaatcttaaaagggaaatctacataatgagagccagttgtaaaatcatcaaatataacaactggattctctacggtagcatttttaatcccactaatttcatctgtatagcccaataagaaactcttgcctgctgttaaaacgggagtattaaaattgtcatcatactctgtagatttgacaatatattttgtcggttgctcatagttaaatatctcccccaacttacgctcttcccaagcatcactataaccattaaatcgaatttgcggcactttcttactcatgcttgcctccaaataattgcttagctgattcgataatcggctgactatcgtctgtgactgctaaatcactaatcatcgctaataagtcagattcactttgttcaatatctcgattaacatcaacgagatcctggctaaccgctaccaaatcaactggatcttcttcttcgaaggtgtccacataacgtggaatgttgaggttaaagtcgttttccttaatttcttcaaaactggccacgtgcgcatacttagcaacgtcttcacgctttaagaacgtctccacaattaagtccacgtcttcttggcgcaacttgttattattcttctgcttttcaaagccctttgaagcgtcaataaaaagcacatcatcagtcgtccggttcttttccaaaaccataataatggttggtatccccgtattcgtaaagatcttttcgggtaacccaatcaccgctgaaatattgcgattttccagtaatgcttggcgaatacgaccttcggcggcaccacggaacaacaccccgtgtggcaaaacaattgccatccggccatcttgcttcaagtgatacaaaccatgttgtaagaacgcaaagtcagcctttgacttaggcgcaatgccggccttgaagcgcgggtcatcttctcggttcgtgttatcccacttcagtgagtaaggggggttggccatcacggcgtcaaacatacgcgggctatcaaccccactttgcaccccatccggccagtctgaactcaaggtatctgcattatggacattgatatcgttatattccaccccgtgcatcatcaagttaattcggcccaagttataggtggtcgtgataacttcttgcccatagtacttaatggccccacgaacaccatcattcttcatgtatgaggcagtcgtcaaaagcaatgagcctgatcccatagctgggtcgtaaaggctataggttggcatatcctcacgaccagccgttaagatccgcgccataatatcagacacttggtgtggcgtatagaactccccagccttagcgccagaattagccgcaaacatcccaatcaagtattcgtatagatcacccaacacatcggcattttcgtccaattcgatttggtcaattaaactaatccaatccatcaaggtcttcgtacgcgtctgcgtattgctaccaagacggcttgaagccaaatccatgtcgtcaaaaatgccttcaaaagtgcccttggcacctggttgaatgccttggttaaagtgtaccaacgcatctgccacgttggtaatgttgaattgatccacgttaatggctgcttgccagtcactaaagagttcacctggttgaatcacataccctaacttggtttgcataaaagctgccgctttttctgggttttgctcccaaactgatgaccaagtttcgccacgtaactggctatccagccatgtttgggccttttcagataagaacttatagaacatcaaaccaaaaatgtagttcttatattcagaaggttcaatcttaccgcgagtctcgttcaatgttttccaaattaatgcttgtttatctgctgttaatgccatgtttatcccttttctatgatgaataatttattttttggtaattttagcaaagtagttcagtagcgactcttcaaagtcagctagctcaaagaagccaatgtccaagtgactctctaagtcttgtaaatattgattcagcgctgtgttatcaactaatggaatgccggggcggtatagctcgtaagctgctagaatatcgttgccattgtaatcatggtcggctgcccacttgtaaatttttaggtcttgttgcgctgtacgaatcgccttacggactgacttgagtgtttcagttgtaaaaggctccgtatactccccttgttcgataccatctaagacttgtccaatctcttcacgattatcttgatctaagggctgtacatgctcttcaacggctgcacggttggcaacactgacttcatccatatacgcattcaataaatcgactagtttatcgtaatcaataatttcattcgcaaaggattgcaacaccagcttgatattcgttaaatcaacttgcttgtcgggtggcaaaacctcattgacatcgttcatgcgcgcctgcagtgagctgagctgcgttgcactctcaatgcctagtgtgataggtccttctggtccttcaacagagctccccaagacatatccttgttgcactaattgttggacttgcgagttaacttgggcggctgtcacggcaaactcgacttgttctttttcagaacgcggcatctgtgaaaaatcatcacccgctaattgctgcaaacgcttgattcgggggttcaagtcgacaattttatcagctgccttaggcgccaaaattccttcatcaaacaactctttttgttcctgatcatccggggtattccccgcatccgctaaggtatcattgccccctttggtatagataaccaacgcatccttcactttttcttccattaccgcaccttgacgataaaaacgcactttaccatgaggtttagctgtcttatcaattgtccggttagttcgtgacattgcttgaatcaggggaccttcacccaaaatcttatccatgtagatgatattaacgaattttgaatcaaatcccgttaataattgatctgacacaataatcaagtccaatcgatcggcatcattacccttgttataaggtttcttacgggcaatgcgcttggtcatatcattgaggtacgcccgttgtggatccttgtcctctaagaaattacgtgtgccgtagaacgtcatgtagtcttgcatcgcttgctttagagcagcttgtaagtctgatgcacccgtcccattggcttcatcacgcgaataggtcatagcaacacgtaactcaggtgctagttgcttgaaaagactgtaataagaagcaacggcttgcttaccagacaccgctaacataccttggaattgattcggctcacggacacccatgttaattggtccgctagcattcgtagcccaattacgctgaatatctgccacaacggcttggcggaatggcagactggcatatacttcttttttcagttccttttccgttaaaccactatccagatcgtgttcaaaatcagtctcataatacgtcacatcaaacccaaggacgttaccgtcaccaatagcgtccttaatcgtataccggtgtaaacgcggcccgaaaatatcataggttgaaatatccttagaggttttcacgtcatggacttcatcgctataaaaattaggcgtccctgtaaacccaaaccaagtggttttcggtaacgcttgtttaattcggctgacggcatcaccgctggctgatcggtgggcctcatccattaaaataaccatccgcttattagaggctagacctgatttaatggccttatccaagccttgtaccgtaatcaaatagatatgggacgtgttatcgtgcttaagagcacgctttagttcactcccattcaccacttgaatccgattttcaaaggtcttataggcaaatgacttaaagttttcataggtctgattgactaagtcaacccgatccacaataaacaaaacatcttcaacccttggtcgtgaagccagtagttgcgccactttaaatgaggtgactgttttaccagaacccgtggtgtgccaaacgtagcccccttctttttcaatcaacccgttttgatccatttcacgcatgcgatctaaaatttgccgcgttgcttgaatctgatacgagcgcatgaccattaagttatcattggctgcatccggaatcatattcacagttactaagcggtgtaaagctggaatacccatcacctcatgaataaaggtcatcgtatttgtgacatccttaccggcatcatcacgccagccaaaggcaaaatcacggttgtacgagtcactattctttggtcgtgcaaaatagtgcgctgaattttgtgatagaacgaattgcacttgcacaaaagaaaagagtcccgtgtacatgccgtcaccgtcatacttttggaactgctcaaacgcattccactggttttgcagggactcatctttttcttcaatgtgggccacaggtagcccgttaatcagcaacatgatatcaattcgacgcttagagcttagactcgttgctaaatccgtaaatgtaatttggttaacgacttcgtaacgtgaatgtccacctgccacttcatcaccatagaatatttcaagttctagctgcgtcccatcatcacgattcaacggtacggtcccaacaccacccgcacccgccaacatgagttgcgcatcatacggcgttttattcttcgttagttccaacttcacttgttcaaactcattatcagataacggagtatcttctagtcgtttacgattgttggcattcagaatatctcgccagtgatcatataaccgatcaactgttacaccagaataatctgttagatattcccaaccttcactctttagcttgtcaattacagcttgttcaaatttatcttccgccatttaactagtcttcttttcttttttagttgtaactatttaccaaaacgccaccactttttaggtttaggttgtgactccgaggtgctattttcagattccggttgtttgtctgacgtcacttctttttcaccatcatcatgcggtgccatcgttaaggctttcaagtccttaatttctgccttgtattcttcgagcagttgtttgtcctgtaaggccaatctttgttgctggtctagtaagttttgcatttgagttatttgtgaatctttattttctatttgcctatctttaacagctaattgttgttctaatattttaaatacatagctattatccgttgtttgcttattatcactggtaacattagcgttaccactgttaccaccaacgttgctacctacattttcactgccgttacgactagaaaaatgctgttttaaaagcctatacccactaaccattactactaaggtttctactccgttactatatacagtttctacgtagtttgctctaaattcatcggttaatcttttcctaactgcttgcttagataccttaaattcatcagcaagttctcggattgtttttaaattgtcactcatgatctatatcctacctttttacgattggtagatactgttcaatcgattttttaagatacttagcaatattctttttcgaatagtcaccttgtttgtctctgatataggctaagtgttctttcacgccctttaaaccacgtaattcttttaattcgtcataaagtggatatacatttttctgtaaccctgacaaaatagtagtatccgttaaatcaatatatgacaatagaaactgctccataagtaactttgtatagggactttttattgccttaacagtcaacatatcttctgtttcttcttgacgaatcttgccctcgatataaacgggatcatcctgtttataactactatcagccgcaacatgttttttagtaatgtgaaagacaatgctatcaatgctgcgtccttttttgactttttcgtatgtaacttgaagcgaagtatgctctgttatttcgtccaaaggatttttcaatatccatttatcaaaatttctaaaatcctgatactcatctattgtatccgtcatttctcgtaagtctcgtatactcatttcaggattacggtaactttgaacttgctcttctcttctgccgcctttaacactgtagtgctcatactggttgtaattcattgatagccaaagatacaaaacaatcgcatacttgctattcaattcagaaatttctgacaaagcatgttgcgtaaaatttgttttgagattaattaaatagggcatgatttcgggactaaatcgaattaatacctcatcatgataatccgtccattctacataaggaattggcacaatgctcacaaacttaaaccctttatcttgctcttttttaatctgaaaaaaagcttgtttctgcattttttcaatcgcttctttaaagcgactatgcttatcgttatcatcaaccttaaagaaagcaaataactcttgctttgataaataaaccgtctgatcctctggtggattatctgtatcaattaaagacaccgctagttcaaacattttaagtggtgttttgtccattttggcgatggatgtaatcagactattatgttcaacgacttttctttttgataattcattcaaggtctgtacctgccttgtctttgattcttctggtataatggttatataaatacactcctttggatgtgttgttggataagcataaagaaaaactttttgtcggggatttctttatgctttttattatatcatttgatagtatagtttttttataaaaaactacacgtatgcacagttttttctacgcgtatctagctttaaagcactgataaagctcactttatacccgcgcaaaagaacaaaagattaaaatataaaagataaacttataataggctgcgcctttttactcacttcatctagtcgatctttaatcttagttttctttcggtccacttggaaaacttgcctaaatttatctgtggcagatacatttccgctttctcccatgaacaaattgttcacaaacataattcatatatctgctcccctcacacttcttaatatgtataaaaaagagctaatttgccaacttttttgaaaattttttttaattttctttagttattttaatcaaaggaattttagtcctgtagtcagcaagtggattatgcttaccagcatagatagcatttttagtaatggattcttcttccagaatcatatctacgaattcctttttgaatgcagtgaacaaataaccaagaatagatgttttaacccttccacctttttcgttgctaaatactctggctaatgttttaaataaaacttcttgacgtttttctaaatcatattcaataactattttgtagtcatattctttttctgcggttctctttgctttcaaaatatggtcaaccatttggtccgcctctttaacagtatttgctctagcagcaatataagttaagattttagaacctaagaagtctaatggttggtcaccacttaatttagtttcagcatagttgtttaataacatacgctcatagttagaatttgtttgagtatttgtggactcgtctagcgcatttagagtatctattcttttagtatctatatctttagtatctgggtaaatatctaaatctagattgtgtgcattttttgcattcccgctgttatcaaggcttccagcatctttgtttcccgatataactggatttgcattttttgcattcccagtgatatcggcgttttgtggaattgcattttttgcattcctgggcacaccaaagtctggatcaattttataaacctcattttatgaatttaaatcattattcttatgcagaggctttttaaaaagcacagtcccacgaaaactataaatcaaaagagacaatcaataatcgaaaatcgattattgattgaatttcaaattaaaatttgaaattatctaaattcatctcaacgaacttaatacacttataacatggggtaaaagtgtagtgttttactaaaaaaatctaataaaatacatatctttattatttcttaatatttagaatgattactaaaatttgagagcgtaaaatatcttgtgtaaatgcataaaagatttctgaattgtatagaaatagggaatgcccttccttatgatatttagtaaccacagaaaacatcacaggaggcattccccatgaatgaacttaccacagaaattatcgccgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcggtaagcagaccatgccagcgtatgacggtctttcaaaaaccttatgcattgatgaatttcgttcaacttctaaccaaatgagcttcattacaattgatggacaaaagcatgatattatcaccattttacctggtcgacagactaatgaaattaaacaattttttctaaaccattattcgctaaaaaatcgtgaacaggttactcaagttgtaatggatctcaacgcacaataccaaactgttattcgttatctgtttcctaacgccaaattaaccgtcgacaactttcacttggttcaaatgaccttacgagccttgaaccaaactcgtgcccagttaatgaaaaagtatcacccagatacccccgaataccgagtgttaaaaccgtattggtgcctgtatcttatgaactatgaagctcttgagaaaagtcaaccacaatggttttcacatttacgaaacagactgactcaagaacaacttatctggtctggtttaaatctcagtcatgagtttgaaaatacttacttcaccactcataaactcgtcgaagcttttcgtaaccgagactatgcagcttttactgcgacgcttgatgaggttgagaacgttagtcctcaactctttacgaccatcaaaacgtttattaaaaataaaaagctcatccaaaatatgaccagtagtacacttcccaacggtccattgaaggcgtcaatcgaaagattaaacagattaagcggacagcatacggataccggaactggaaaaactttgtttttcgtattcaaattgaatttaaaatcagagtaaagaaaaggagccccgttcgcaagtgaacgaagttccacataaatcctccatcaacacccgttgacaaagagcccttttatgatggtttttttgtttgtcggagtctaaaacatgataagatttagtcaattaggagaataaaaatcgtgaaaatcaaatttcttactaaaaaattttttagagcgagactatctgaatttatctctgttcaaactgataactttttgagaaaattaaagccgagaccgttttttacagaatatatcgagcaagttttcagaaagaacgttgaacctaacgttagccaaaattgcttgactttatcggttttaacggacactcatgaaaaagctgttgccagttcatcgtactatggtctcaacggtgtaaggcatattattgaagccaataaggcttgcgattcattgccagtggattacaatattcatttaggcgatttgatcgacggtagtgataagccagagatcagtcgaggattgttacaattcacgatggaaaattaccaaaatagccagcgtcctttttatgtgctggaaggtaatcacgatgaaaatgataagtatgatgaacacaaatttattacttcagcctcatttagacgtgacgactactataatttggtaacgaaacatgatttcgaacaacctgagatcaaacgcttgagtcttggttccaaagttgcttggatcgataaaggggatattcgagtaattttcttgaatacgagcgatattccctatatcctaaatggcgggaccaagaagtacaacttcaaaaaagtccgtggtatccgcgagcaacagatcgaagatttaatatctattttagaaaagacaattgataagcatgtcgtagtttttggtcatgctaatttgatcagtcaaagtggtcgttcagctttgaacttcaacggtgacttagttcagaagatttttactagctttaataataaggattctggacaacttaaaaatgaattatccggtgattttggagttaatgttcgctataactttactgataccggtatttcgaccatatcgaattatatttgtggacacatgcattatgaaaagcgctacaaagttaatgggattaatcatataatattaaattgttcggccttaatgggtaaaaaacacggcctaacgactgattataataaaaaatgggatcgccgatataatgagatttccgaattagctggatatttcattaatatcaatcccgacaaaatgttgctccaaatatttggatatggtgcagcagccagattcgtaagttttgaaatttaagcctcgcaagcatatttttttataaaacatagccaaaagcttagccaatttttgaattagctatgtaaaacattggtatatcaacgtttgtgagcagtcgggtacaaaacccgccgactccattaaataggaaaagctggtacagctaaaggtttgtaatccttgttgtatcagcttttttgtttttctttattctgttataagctattaaaacgttgatatatcaatactttcaaaaaagagtttcttgtctagttttactagatagtattaaatggcaacgaattttcaggggagacttggaaaaagatactgatattaatatcggtatcttttttgtttgtccactccctttaaaaaaacacccttacttaaaatattgcaaatctaatgtgacacttaattttatagccatttatctattttcttccagtttcttaaaattttatttatcgtaattttcctagaattgtgtttttctatttgattttcttcgccgttcgtttattccaaattatataagttttatctttattctttataagtgcaagtttgcatttattaattttaggtttgaatatgattaaaaaacggtttactttagattaaaaaagaatataatgtaggtgtgtattaattagtacacaccgttaattgtatatactttaacatttaccgtatgcttatattaattttgttgtcactttagataaatgaaaggatatgattctatgaatttaattaaagccctttttggtacacctactaaagatgttcgaacactttgtgaggttggcccatgtccctgcggtcaatacttagcccatggttgtcatccggccaaaggatgtgctgacatgtgtgtaaatatcggtcatttaggttaatcgcattatttatgatttaaagggctaatataaagaaggttatactatgttgaaagtttactataactctattaaattagtttggaaatctgtagaagcgtggttttttgtgacaactacgcttcttatttttttaagtttggaaccgataatttcaatttctctagtaaataatctagttaatagtgttcaaaaaatgttaattgctggaagcaaagggataaacttgattatcgtaattttaatgatccaggttatactttcagttactactaatgtgattcaacaaacacaaatttttttggataataagtgccaaatagccttagaaaagtttttaaataatagaatttttaaacaaatgacaactattccttatgaacaatatgaggacgttgattatcaaaatcatctagatcgtttaggcatcaataagggtaataaatttatggcacccatcaaaagttttttggatataatccgaagtactataacttttatattgttattcgtttatctctaccatttaaattcattaatttcactactatttatatcatttgttcctttaatatgtataaatttgattattggaaaaaaacaattttatttgcacgtctaccaatcccctaacgcacgaagaatgtcatatctagattcattactgacaagtagaaataccggcaaagagctaagaacttttaatattgggacatatttcataaaatcttggaacaaaacctatgattttgtaaataataaagttcttcaattgaataaaaatactttattatcgaatatcttaattataattcttgaaggtcttgtattcttaattattagcctaacgtcagttagattagtactaaatagagaattatcttttggtagttttgtagctctggcacaatcaactttagttttgaatacgacattagagagtatctccaactcaattaccaccatatataccgagagcttttttttaagtgatattttagaattatttagaaaagaaaagccaattcattttgagaataacgaaaattttaaattaacaaaggcaaaatgggactcaattagttctaataatccgctaattgaatttagacatgttaattttaactatccacatagtaaccagaatgtgctggtagatattaactttaaaattaacaaaggcgaaaaatgctttatagttggtgagaatggttccggaaaaactaccttaattaagtgcttacttggtttatataaaattaattcaggtgaaatactaatttgcggtaccaatatcaatgatatagaattggaatctttgtataaatttgtagctgttatctttcaaggctatattaagtacaacctttcgttaaaagagaatatcgttttaaacaaaaaatttaatcgtaaaaagtttgatgaattacttaaacaactcgatttatacgaattaacaaataaactccctgataaagaggacacttacttagggaaaatgtattttgaaggagaagacctttctggtgggcaatggcaaaaaatagcattactgaggtctttttaccatgaaggccatttattcattatggacgaaccggccgcctctctagatgcaaaaatggaagatttaatttattccaaaataaaagaaataaaaccttccgaaacaattatttatacgtcgcacagacttgcttttgcaaatgtcgctgataagttaatttttctaaaaaatgggaagataacgggaattggatcacataatgaacttatgagaactaacgatgactatatgaaaatgtacaacattcaagtgaggtggtacaagtgaacttttatttaataaaagtgtatttacttagtggattttattttatttgtttttttatttttcttcatttaaaacaaataagtggattagatcttaatttacatccctttgatgtcgtaaatttatgcatattcttaattacgtttcctgtaaccaaaattgtacaatctagaaataaaacaaaaaaagctgataaacccctacctaaatcaaatatcagaaaaaaatatgaggaaaatggagaatcatttgcccaaattcaatattcacctgcttggagtagtcacggattaggaaatgagtctggtgaatggatatttctgttttttaaaaacggattaatttatataatttcgccgttaattcttttaatttttttcttaaagtttatgaaagaaggaaaaggcaaatgaaatatttaaaggcatacttaaatataaaaaaatataaaagaataataaaaaaatcacagaatatcattgaactagatttttctgacttaaagaagcagttagcaaatccagataaaaatttcatattaatcggaagacccacttgtgctatgtgccaacaaagtataccgtatattgaaaaggcaactcaaaaaggaaagtatgatatatattattttgatactgataaatatgaacctaaccagtatatgaaattttttagtagtattggaattaaagtattaccttccctgctttatctaaaagggcagaatacatttgaaagaatgagcgtttataggccagaaaacgctatagaattgtggctgaacagtgttactggtcaatgaagtagacttctaaaaaatatttagttgttaaagctgttactgcattaacaactaacaattataattgaaaagtccactcttttcagattagtcttttcggtctttattttataatttcattattgattgttattttcatctacctttccttttaaataccctctatattaaaaatataattttcatgctacactttgctaaaaagaggttcacttgaggaagagtgttgaacatatatggttattgttctcaaaaattaatggaggcgtcaatgaataatgaatttttaaaatctacaattttagattgtttatgctatacgacacttgtttatcagagaataaataaaaagttagactcggttatggatgagttaaccatcgaaaatctaattactgattgtattaaaactgcggattcaattagcaaaaatggaaaaaattattatgtttacaactataaaaagaatatttcagtaacaattaattctaataattttagagtaataactgtaaatcggttgtaatattttttatttactaatatctatatgactgataataattcaattattgatgaaatttataatctaactttatattagaaaggtaaaaatgaggcgttttaaggatatttattcagcaaccgaactttcatccctactaggattacttcctgatattaatataaatattgaatatactaataacgattagtgtaacttagatgacagattacacaatgttttagtatctaaggatagaatgacaaatgacgaattgaatgagattggattgttagtcgaaagtttaatcgatcctataccttaaatcactagtatattttgaaaaatattacgatagcaaaaaactgatacaaccaaagattccctaatccttggtgtatcagttttttaattcaaaacaatttgtaactacattttatttcaaaaccggatcaaaatactttaattctcgataatccacatttccaccatctgtaattgctaaatccggaatagctgtaataggtaaaaatgacaagtaaaagagtgggtcaggaagttcacatcccaactgattggccgcctcttttaactcgatttcttttttagctaatgtcctaggttctaaatctgtcactattccaccaattggtaattgtaagaaagaaattatctttccattatccaccacaatttgtccaccgccttggcgaatcaactcatttacagccaaagccatatcctcgctgtttgtcccagctacgacaatgttattgtcatcgggagaagcagaagttgcgatagcacctgacttaagtccccaacctgaaatgaatcccttggagtgattaccattaattccgtatctttcaataaccgatactaaagccacgtctttctcaacacttggaagaataatgccatttcttacatttaaatccacatctttggcttttcttacgaatggaccgacacttttaatagttctcactttaacagtactgtcctgttgatcaacttgatatccaaaatcgtttttcgatacggaagttaacttaattgatttttgtattgtttgagaacgtgctggcggaatgaaatcaattttttcgaccccattttcaaataccatggttcccttactaattactgttttaacattaaaactttctggacgatctatcagtaagatatctgcgtcctttccaggagcgattgatccaacttggtcttcaatatgataggcttctgcaccatttaaagtcgccatctgaatagcagtcattgggtcaactccatgttgaattgccaatctaaccatatgatccaaatgtcccttttctagaatatcatgagctgtaacatcatctgtacaaaaactagtatgacgagcaacaccacttgctccctcagttatagctttgatattttcagataaaaatttagttacagaagattcgcgaataactgtatgaattcctttacgtgctttctctaaaaattcttcatgcgagtaactttcgtggtctacacgtacccgactcatcaaaaattggtttaactctcgtccctgagccattggtgaacatccaaaaatcggcttatgtaatttttgagctgttagtaatgctgataaagtatctgaatctttagttttaactgcttctctaaccgtctcccataccccatagcactgctcctggggttgcatattttgatggtccttagcaccaacattatatgcaattgtagattgaggaattgtatacggtgttttatatggtaaaccccagaagacttttagcggagattgcttgatttcatcaaatatttcgtctaaaccttttacaccgattacagaaatgtattcatcaagaccagaaacgatgcttgtcgttccacaagctaatacagcttgagcgaaacgagtcatggtcattttgctacattcaacgtggatatgcccgtcaatcaatcctggaactaaatatttgttatgggcatcaatccgctttgtgttctcacctatatacatagaaatatctgaatcaaccgctacaattctcccattataaatggcaacattagcttgataatattcagatgtatccacattgactaaggttccattctcaataactaggtctgcaggtatcgttccatatcctgcatcaatatatttttcaagttcgttagttgtaatcatccttttctcctcacttacgacttaggtacaatatttaatacatacagcaacaaaacgaaaacaaatagcaaaatccacataatgtagttaacttctttacgtcggccagcggcaaacatcagtatcggataagtaagaaaaccaaacgctattccgtatgaaatgttatatgttaaaggcattccaacgatcgttaaaaaggctggcatagctatttcaaatttaccccaatcaatttcgcgaagtgatgaagccatgagtacccctacaacaattaaagctggagcagtaacttggttagttaccacggttaataatggggaaaagaacatactaaaaacaaacaaaatcgataccgttagtgaggtcagacccgtcttcccaccaattgcaatgcctgctgaagattctacataagctgctgtaggtgtcgtccccatcacggatccagctaacatggaaactgaatctgccatcaatgcttgtccaattctcggcattttattatcttttatgattccagcttgttgggctaacccgattaaagttccagctgtatcaaaaaaagcaaccaagagaaaaatcaaaacaacagcccacatttgtggatccatgactgaaggtaaataagaaattccaactccaaacgttggtttcatacttggagcaagagaaataatattagctggcattttgattagaccagttattaaacctagcaatgctgttgagaccaaaccgataaaaatagaacctggaacctttttggccattaaaatagcaataacaaatattccaaaaatagttaaccaagtagttggtactgctaaagaaccaatctcaactaaagaagttttactagcgacaaccaatcccccaccttgtaaaccgacaaaagcgatgaagataccgattccggcagccatagccaattttaaatctttaggtattgcatcaattacaatctcacgaacttttaagaacgacagaatagtaaagagcactgaagcaataaaaacacctgccatggctttttgccacgatatccccattccaagaactaccgaaaaagtaaaaaatgcattgtctcctaacccaggagccacagcaattggataattagccaaaaatgccatcaagacgcttcccaatattgctgataaagcggtcgcggtaaatactgcacctttgtccatccctgccgcacccaagatactaggattaacaaataaaatataagccatagaaacaaaagtagttaaaccagctaaaatttctcttttaaccgttgttccttgttctgacaaatggaaagtcttttctaatagcgtattttcaatcgccatctgattgttcgccttttgcatgacaattacttacctccaggatgttttattaatttcaaaatgattatcccatacatttttgtataattcaaattctaatattcgtatttaactattattattttgataaaaatgctaaaatattgtgcataagtacaaaataacgaacctttataacagaaaggaatttatactcatgtctaatgtaactaaagaatttattgccggacttcctaaagctgaattgcatttacatatcgaaggaactttagaacccgaactaaaattgaagttagcccaaaagaatcaggttgatatcggtcaaaagtcaattgaagaagttaaatctgcatatgaatacaatgatttagcttcatttttatccgtttactatcctgcaatgaatgtgttacaaaccgaatctgatttttacgaattagctttcgactacttgaaacgggcagctaaaaacaacgttcgtcacgtagaaatatttttcgaccctcaagctcatactagtagaggtattagttttgaaacgattattaacgggttatatcgagctaccttagacgcgcgtgccttaaacattgatgcttcactaatcatgtgtttcctacgcgatttcactaaagaatccgctcgtaaaacgttagaatcagcacttaaacaccgcgacaaaattgtcggtattggtctagattccgatgaacataataacccacctctaaaatttgctcgtcaatttgaagatgctgcagctgttggattacaccggactgtccattgtgatattgaccaaaaagattccatagaacacatccgacaagctcttgaaattatggaagttgagcgtttggatcacggaaccaacattgttgaagatcctgatttagttgatttagtagttaaaagaggaatcggattaacttcctgtccattgtctaatggatttgtttctccagaaatgaagggtaaagaagtcttagaattattgtctaaagatgtgaaagtttctattcactctgacgatccagcttattttggtggttacatcagtgataattattctgctattgccagtaactttgaactaactaaagaacaagtaattcaacttgccaaaaattcatttgaaacttcttggattagtgataagcaaaaggaactttaccttgaagaactgaacacttacgttgcaaacaactagtttgaacatttgatttagttaaattaaatatttgttagataatacaaatttgaccgaatcacttaactcgaaaaagacaaaaaaactgatacaaccaaagattccctaatccttggtgtatcagttttttaattcatcatatttattttccgtaaagcttaatcaagcatcccaaatttttcaaaatgttgtttcaaatacgagaccgttaaactttgtgactgttgaactagttcctttggtgcaccgcttcccattagttggcctccagcagcaccccctttaggacctagatcaatcatgtaatccgcattagccattaaatctaaatcgtgggtaatgataataatggttgctcccctttgtttaagctggttgattacacctaataaggtttggacatcgcgaggatggagccctacagacggttcgtcaaagacaaacaacgtctccttctgggttttatttaaatggttaactagtttcaaacgctgagcttcgcctccagataagcttggtgtgctctcccctaagtgtagataatccagtccaatttcagcgagtaatttaagttgtttctcaattttaggcacatctttgaaaactacaagagcctctttaaccgataaatttaaaagatctacaatactataaccttgccaaagaattttttgaatctctggtttgaagcgcgttccgttacaataaggacaaacttcttccatatctggtagatattggatatctaatgaaatcgaccctactccaccacagtgttcacaagcgccctgtttattgttgtaagagaaataggcaattccataatgcttttctttggattctggcaaattagcaaacatccgccgcaaattatccatgattgaagtataggttgctagactagaacgggaattttttccaatcgatttagcatccacactaacaacattggttagtttggtttctagagccttaacttgctgaggcatcgcttatcgattggctctagcttcaatggccggaaccaaactatctaaaattaaactagtcttaccggctccagaaaaaccagttacggctgtaatttcgttgcctggaatggttacattaatatcttttaaattaaaatagtttttaaccgttaactgggtgttcagctcctcattttgagaagttgttggaactttatcatgcatgatattggccttaccggtcataaatggaccaattaaagaatccggattctttcttaaattttctggagtatcttcggcaataattcgaccacctgcatcccccgatccgggaccaatttcaatcacccaatcagcagcttcaataattgctacttcatgatccactactaccaaagaatttccctgctcaatcagtgccttaaaaatattaattagacctttaatattatcgggatgtaaaccaatagatggttcatcgaggacatagagaacccccgtggtttccgttctaagcgtcttagccaactgaattcgttgtaattcgccagttgataaactatttccgtttcgtgataaagctaggtaatctaatcccaactccaataagggccgtaaagtgtcgaccagttctttaaataatacgttcgccatcgcctgcatctcatctggcaataccttctgagtcttcttttgccagtcagggagttgtcctaaagttaagtctgaaacttcagcaatatttaaaccaccaactaactgggtcaatagttccggttttaggcgggaaccgtggcaagtaggacaagtggagaaatgaaagaaatcatttacccttttaattgctcgatcactcttaacggtttttagtgaatcatagaccgcctcataagcattttcataaagggttttatcagtatggaaaactcggccggtcgaagtccgaaaatctaccgcatattgttttttctctccatggagcacgatctctttttcgtgaggtgttaggtctttataaggaacatttattctaactcctaaagtttcagcaacagttggcataaaattccgtcctggcaaatgccacgaagcaactgcaccttccgctaaagtctggttttcatcaccaattaatttggattcatccaattcacgaacccgaccagttccatgacactctacacaagctccaccagaattaaaggcaaaatcttcggctgacttggccataaattcaatgccacagattggacaagtgatgattcccattctactatccgttccacctgataagtccatcgattgagcaatttctaaactaggttgaatccgatgcccgttgggacagacagttgaacccaatcgtgaaaaaattaaacgtacgacattaaataactcactcattgaacctactgttgaacgttctgaagggacgctagggcgttgccgtaaagctatcgccgatggaatatgacgtacttcttgaacttgggaacgtttattttgattgattcgtcgcctggtataggtcgataaagcttctaagtaacgtcgtgatccttccgcatataagatgcccatggcgagtgaactcttccctgatcccgatggacccgagatggccacaaactggtttaaaggaatattaacattgatattttttaggttatggacatttccgccccgcacttcaatctggtcaacttttgaatgcatttattagtcccccatcgtatgattttcaagtaattattttatttaaatttgtatagtaagtcttatctttgttaaagggttaatcgtgttcctcatcttatgataattcaaataactttatatttcagcatcctacaaaaaagactaacctcagaaggttagtctttcaattctgacattcggttatctagccaacgttggacttcttgtaaatctttgacattggctaactgagttatataccttttagtatctgatcttgctacagtcttttcgtgggctttttgatttcgttgattacggtttttatcaactctatcctgcattgcttttttcattaatccacttccccatgattttgatgttctattttacttgtaaagtatacatgcgaaccgtccaaaatttatataagaaagggttaaaaagctaataacaataaaaacttaataattaggttccatttaagggagttgctacctttctgtcaattaataaagtttaaagtaaaataagccccaatatcgaactgaaattcaatattggagcttattttattgattatcaacagaatccttatttaaggtcatttaaaatttcactaagtgctggttgtccatccgtcaattcgtattgttctcggaaacttttgatagttgcttcatcaaaaatttgaggatctaacggcatgaatgaagtgtccacaggatcattatttacaatcttagcatccaaaacaatgggttttgtgttacctgctttttgaagttcaacaattttagcaaaagctttcgttaatgaaggtaagtctgtcgcagtcaatccaattgcgcccatgttttcagctattccggcccaattagccccctgtaaatcaataccataaggagcttggttagcgactattttttcgtgttggataaatccaaatgatttattttccaaaaccacgttaacaattggcatttcgtacttaacttccgtaagcaaatcttgcatgaccatggcaaaaccaccatctccagaaatagtgattactggacgctccgggtaactcaatttagcagccattccggctggtaggccataacccatggttgcaaaccaacctgataacgtaaatttttgattacgattcaacggaatttgacggatggcccattctgtattatttccaacatcaagaccaaagaccgtattgtcagcagcataatctttaatggctgccataacactctctgcccgtaatccatctcgatcatttttagataatttttctagccaagcatcccaattagctttatccttttgagcggcttttagccatttgcttgctggtagcttaacattttgagccaaaatagtatctaaaaattctttagcatcagctaagatagccatgtcagcatcgcgttgtttacccaaatcttcggggttattgttaacttgaataaccttaatattgttaggccagaaacgagcaaacgggaagttggtgccgacgaataagattaaatctgctttttgagcaacttcgaaagcaggcttagttcccagacgtcccatcgaccccatgaaactaggatgatctgatggcataattcccgtacccggcactgcagcaacgactggcacttgaaaatcttctgaaaattgaaccacttgttgacgtgcgccagcagcacctcggccgatccaaagtaatggatgtttagctgcttttaaagcggcaatcgtgtcagtaatcgctgaatcggcaattgctgagtgaactggttgttggtaaattttaggtgttttaattggggtgtagtcaatttcttgccctgctaaattatctggaataattacgactgctggccccttttgggcataagcagctcgaatagcttcatcaaccacatatggaatttggtcggcactaaccacttgtttatgaaaaactgctacgtccacaaacatgggatcttgattcatttcttggaagaaattagtattcatcacttccgtactggattgaccaactaacgctaataccggagcgtgatccatttttgcatcatataaaccattaaacagatgcgttgctccgggacctgcagaaccaaaactaactccgattttaccagttagcttggcatcagcagtggccgccaatgcaccaacctcttcatgacgaacttgaatatacttcaaacctgctcgttcttggtataatccgtccacagtgttattaatagaatccgctgtaataccataaatatgatcaatatcccaacttttcaatacttgagccaatgcttgacccgctttaatttttgtcatagtaaactccccccgttaagcaatattaaattcgcttactttttgtaagtatgtaactaggataagtcgaattattaaaagtgtcaaggatctgttggaattttagtagtcaaaaacaatccgtaatgataatttttagtttaattacatcgtttcgctcgaattgtggaccccaattatgttatcgtgaaggaaagtaatcgaggtggaaaagatggacgaaaaagaatttttccaaaggttattagccatatcaaatgctggaattaactattctaaagatccgtacgatattgaacgcttcgaagatatatttcagattacacaggaatttataaattcccatttaactcagaccaagttagaatttgaaaaagaagctggttatccaaccccaaaagttgacgtacgggccttaattttagatgaaaacgatcaaatattgttggtcaaagatgctctagcccaaacatgggcccttcctgggggctttgccgaagttggcatctcgcccgttgaaaatgtcataaaagaagttcatgaagaaacagggttaaacgttgccgtaaataatttaattgcggtttatgacactaataaatctaaccccgaaaattcattagcccattactataaattaatattttattgtaaaaaattaagtggtgaattaactaccagcctagaaaccagctcgattgcgtttttcgatttaaaggaactccctgagttatccaccagaagaaatactaaaaaacaaattatcgaatgtttcaagaatcgagaccaacaaacgttgatcgaataacagttctacttgagcagtcaaaaaaataaggaatactcatcgtaatcggaatgagtattccttatttttttatatatgctcttttttaaccttgaggctgcttaatttcgctgatttgcgttgtgttcgcccaactatcatagaagaagtacccatgtttaaatccgattccccatataaaattcaaacccaagaaaaccgtcaataagcctagcattcctagtaaaaagatattgatttgagactgatgcattttactgaagacttccacaaacatgtagttaaatccccacaaaattggaagagccccatcataaattaataattggcgccagattaattgcccgattccagctggtttaccagatttttgggtaattcgaatcttaactacttttttgccaatcgtctgaccgcccgttaacaccggaatgatgataaagatgattagggtgctgataaagtatgaaaaataagcgttctccgtcaatttatccaagcccactaaactcagaaaaatcccaacgatagttcccaccactaggtaatcaaaaattaatgctactagccgacgaaggactgtaactttgcgcccttggtcataacttctacgatctatttgttcgcgcgttggaaatgcctttaccaagaatggcgtaattaaaccgccaacgaaagccccggaagtattcaaaattaaatcatctacatcaaacaatcgataaggacggggataaattccgtacaatcctgataattgagtcagttcaaagaataaacttaatccaaaaccatataaaatgattttacgaattggctgcttgaaataataacgtaaatatacgccaaatggaattgttaggatgatattaaaaaacggttgaataaaccctggttgcttcacagccggtatccaagtttgtggacgcattagattgaagtacgttgtggagataaattcccgcaaagccgtaaatgggatcaaattatagcgctgagtcgttaagtgtctgacctcctgaatcgaaggtaacggtaagataattaaaaaatatgcacaaagcaagtagaaaataaaagtaaagatcacaatcgatctccaagcaatgattccaccgtaacgatggtattggactattaaaaatggtaaagataacagtatcgcaagcactggaaatatcaatattgcggacttaattggaattaaaaatgacattggttcacctaatcgctcaaaagcaactttctctttcaaaaatattgtgtatatttattatactgattaatccgttagtggtagtaatgattgcacttgcaacatcatagcaagctagttttctatataaaaaagacgctaaaattcagcgtctgattagtttttatctatattttccagtatattcaatcgatgggcattgcttaaagtcgtaggtactcaaaccttctggattgtcgaaaaaggcggttgctgattcagttaacatgatattgacggcgatgtcacgatccaattttaccgtaacgaccggtttgtttaacatgttagccactccaatttcgtaggctgttccaggatcaacttccttaccatcaaagtctaagatggcaacaatgacatcactttgtctgatagcttccatatcgagttcataaacatccttggcccatagtttggttaaaggctcatgcgttccttcttggtgtaatcgtggagaataaacctctgtaatcgttttgttcttagctaaagctttttcaacggaatcgataatctcaatttgtctttcagaaaaaaatggtcctgctaaatatattctagtcatgcgctttgaactccttcatcaatattttcagttaacgactccattaatacttgatagtcgctactaatcactatgttttctttatactttgaatccataaaaccggctagtcgctcttatgattctcaataaagtttcattctattcgatatgcctaataggtattaacttaccaactttttcagtagtatttttatacaaaaatcattgatatgcttcgaccgttaacttcaaaacaaggatctcttaaaatgaaatataagttattagtttactataataaacgaacgaattcaatatatggtgtgtatttaacccattaactcatacatatggtatatcgttgatgggatactatttattgacccagttgcataaaaacattcttattattaagaagaaacatccaatcgttctcaattttcaaccaaaaaagaccaatctttataattgatcttttaaaagcttagttactgattcgtttttttgtgttattttccaactctattacataggtatcgtatgattcgagtttaatatccatgtgttttaaagcatcatcaatttgggctcgtttctttaataatgcttgccgttgttcaagtaagatttgtttacgttgctcacgagtttctgaacctttttgaaccaaccccacgtatttcttaatagaagctactgttactccagaatttctaagagcctgcacatagtgaatccaatacagttcatctttttgatagtctctaactccatttgaatctcgatgaatggcaggaattaatccctcccgttcataatatctaagagtttgaatcgatatactaaactttttactaacgtcagatattttcatgtagttctcatccttactcttaagcattttaacaacaaactaactcaggtcttaacacccttagctacttaatattttcgagtttacaccctatacctaactataggtcaatttaatttaagcttgattagtaggataaatggtaaattcactgatatcaacttcttctggctgatcaatcgcaaaattaaccactcgtgcaatcgcatcaggagcaatcccatgttgttgataaaagtttttcatgttagtagccgttttttcgtcattaatatggtcaagtaattctgtattgatagccgctggataaagggtagtcgttcgaatattagttccttcgttcgcactttccatccgagtaacttccatggcatttttgaccgcaaatttagttgctccgtaaacacctgaaccaacgtaatttttaagaccagcaactgaagaagtagtgataatatgaccatgtttttgggctgtgaaagctggcatgacagctgcaatcccatttaagactcccttcaagttaacatcgatcatccgattccattcttcagctcgcaccgcactcatgggtgaattaggcattatccccgcattattgaaaattacatcgattcctccaaagctatcttgcgccgcatccactaatttttggacttcgtcgggtttggtaacatcaactacacgataatcagctcgacctccatcaacattaatttcattggctaactggtaaagacggtcctcccgccgtgctccaagcatgaccattgccccgtttttggctaatagcttagcagtagcagctccaattcctgatgaagcgccagtaataactacgacttttcctttaattgacattagtaaatcctcctaataattaagctttaattgcaaattccacgtctgctgaagttagttgactcaaacacgtaagatcgctatcaatatgaccaatcggttgctgttcaaaaatctcaccattttgtttatacaagaaaactagtgagcccatgggtggccagtatgaaatatcaccgatttgatagctccggttacccacatttttatcaatcggcaagccacctcgtccaaagcgataacacatttcacgcgaatataaattatccatttgaatcgtgaaaggcatttttgcgattaaagcttgcgttgtaacattatcttcaaactgagcgattagtttttgttgatgattaatcgttaattcaattaaaatttttttactcatttattaatttcctttcttaatttggttgctaataactatttaataactgcattatttcgcagccagttactgatttctgaaccactggtatctacagcatgcgttgccaaacgtaatcctggttttacctgagcttgtggaagcatcattttcaaatctttttgcgtattttcgatcccgacatccccagatgtacaaaatggaatcaccgtttttccagtaaagtcataagcttccaaaaaagagcgaataaccataggctcgcgataccaccaaatcggatgaccaaccaaaatcgtcttgtattgatccatattctgaacatgactaactaatggagggcgatcatcgattaattgttcttgatgggcttgaatggaacacggatcatgctcctcgggataagcacgactagtttcaatttggaataagttgccacccgttaatttttgaattgcttctgcaaactccctactgtgtccccaatgactaaagtaagcaattaaaatattagatgccataattaatttctccttaactatctcttagtaaaatgaaggtttatcccaagcagtatttggttcaacaatgccaacgctttgctgactttcatactctggatgttcgacaacttgagcaataaagttagccaccgcctgtcgggtcacttgagtacatttcattggctgtcctttaggaactagttcaaaattttcattaccatcttggtcatatagccatgacatccggaggaaggtgtaatctagtccactttgatcaaaaactagcgccgctttttttattgatgtgtagtcgcccatcatccgagcattccattcaccaaatcttccaactacttcatcatagatgcctaatcctccagcaataatgattctagtcacctgagcatttttcatggctgaaaccacatttcgatttgcttgttcaaaatgccccgtagccataaaaacaatctcctgtccgaccattactttttgtaaatcctcaggttggttccaatcaccatccaccaaagttattcgttgttcatcagcatactgggccaaacgctgagtcgcctttcttgcaaacagcgttaaatggacatcggattgattcaataatttagggattaaatacttagaaatattactcgtagctcctaaaattaaaacatttttcattagatatactcctttttgatagggttaaaatcattgatgaattcattatgcttcaaaattaattgacacggaatcaccaactcggtagcatagtattaactaatagttgatacgaggtgtgcgcatggaaactaagaatttagagacttttattgcagtggcaaaaactggaagctttacgaaaacggctgaacaaaatttcatttctagtacggccatcatgaaacaaattaaccgtctagaaaatgagttaaatctcaaattattcacgcgttctagtgccggtgttcaattaactaatagtggacaaacttttttgaaatatgcccgcgaaattataaagctcactaatcaggcctatcttgaaagccaccgggatgaccaacatcgtcattcgatccgcttaggtacttcgctccttcatcccagttctcccttcatggaaacttggaatcaaattaagcattccatgcccaactaccagttaaatatcattcagttagctggcgatttaacctctaataatcgtgaatatgctatgctaggtgatcaatgtgatattatgattggaacttttgatgatgcaactacccgccatttggtgcaggccgtccctctaggaacttaccaatttggcattgccgtccgtagcgataatcctttagcgctaaaagcttctgtatctattactgatttgattgaacaaacattactaatggttcctacaggtgtcagtgaaaaaaatgatcaagttcgtgctgaaatattatcgactctcccccatgctaatattaagtacactgatggccgctacgacatcaacgtatttaaccaagccgtcgacgaaaacttagctttaatcaatatcactccttggaaagatattcatcctaacttagtatccgttccgcttcagaccaccaccgaagtcgagtatggtctattagccgctaaaaatgccaatactgaagttaagggctttgtaaacctagttcgccaattaaaacagcgaaaggattagagaaatttgagatagtatacaaaggactgaaaaagctatcttctttaacaaacaaaaacactcttattcactaaaatgtgaacaggagtgtttttatattctagttttatttacagaactttattaattgcgatcatcgaatcctcaatatggtttttaacaaacgtccttttggatagtattaggtataggaatcgttattatctccatttttgcgccactaactgttttaatttataaacgaaaataactagaggaattgtatttgatttatcaccaataatagtactaacctcagacggctatattactgattatcttgggtggcactggatttaggataaatgactcatcattgttatcactttggttatatcattattgtttatggccgaaattgtagtaggtttactttcggttcatacatacagcatataattagtagggtatcttttttcatcagggataattagcttatttttcaaaaattttactaactccctcttcaaaggaagttattttaaaatcaggaaacttggctttaaatttatcagagttgaaattgttatcatacttatatcttggcaacaattccattaattctttaattttaggattgaataaacttcccaatctaaattgccacatcttaattaccgaaaatttaactgtctggtttgtcacttgctccgtaacttttatgatatcttgataactcactccctcagcgcatggtaaatgccagacttgtccataagcatccggtgtattaccaattaaggcagtggctttactagcatctggcgtccaaatcaatgaccgtaaagtacgatcgttgatcggaattttagcagcttggccagcctttacacgatcaaaaaccatcgtattggtaattccttgtgttttcgctggtccataagattctggtgctcgacaaattactgcttgtagttctcctgaattcattttatcttgaaccatttcagctatattagctctaatcacagactttcgccctttaggaacaaatgggctattttctgtttggacatcactattcttagcgtacatgtaggtattatcgaagaagactaatttgctattattttcgatgcacgcttcaatgacgttcttcacgactgtcggaaattgagcttcccataatgctatattcatgggtaatcccactgcaaaatacacgatttcactgcctttaatagcctgattagtttcttctgcctgcgttaaatcagccgaaactaattgatccgtctcatgtattttcttcggatgacgacttaccaaccgtaaatccttggtgtaattttgatataacgctttaactatctcttgacctatttgtccgttacttcctaaaactgtttgcattattttaactcctgaattaataattgggctactgaacgcactgagaagggattttgtcccgtaattatacgtccgtcttgaattgcataatttttataaaaacgtttcttgttgaaattagccccgcgcttttgagccatctgttgatttaaaaatgggacagcttttcatttaccagcaatgacttcctcactagttgtgaatccagtaatatttttgttcgcaattacataatcattgttatgatctctaatattaaaaagtccggcaatcccatgacaaactgatgctaaatatccaccatcctgataaattgagctggcaagttgttgaatttctatattatctggaaaatcccacattacaccgtgccctccggtataataaatcgctgcgtattggcttggatcaacatcagccggtttcaatgtgtttctaagtgctcgctcaataaagtcaggttgctcataaattctcataattgagtgatcaatgtacttcatacttctgggatctaatggaacaaagccgcccttaggactaataaaatcaaattgaacatcttctttttgaagttcatccacaaactctgcactctcgccaagccacaatcctgtggcctcttttgtgtcaccatattttgcaacattagtttctacaatcaaaactcgtttcatttactttcctccatcactactagtagctcatcaatgaaattctttaatttcaaaatttcttcagtatggtgagttagataataataatttcgcgttccattagtacgataatcaacaatcttagcttctttcaaaacttttaaatgatgcgaaacggctggtcttgataaaccggtagcttccgttaactctccaacttgcaacccatcacaattcgattctgacaataatttaataataattgactgtcttttttcatcacccaaagtaactaaaaattcacttacactatttaaatcttgttttaattgattaaaatcggtcatttatatatcttctttcgtttaatggtttaaacaattaaaccattaaggatgaaaaaagtcaaatatttcaatataaatttatatgttatacgtgttagtattctcaacaaattaatctatatctacatttaattaccatttaacatagtctaaaaacacattaagttaagcattttagtaaatctctaaagcataaattaaatgttctagaaatctgtataataataggcgacaaattcgcttaacactccgaatacgtcgccttcaatattaaataaatgtctaatcttctatcttaaattaataaccgtttataaatttatttcggcctgtttagcagctactctttcactaatctttaagaacggccagtagattaaaactcctaacaccatcgttaacccttgaacaattggagctctccagtcgccaccagtagctaaatatgaattaaggagtggtggagttgtccatggtaccattacaaccaccctatgcatccaaccaatggctgtaaagaagtatgcaatactaattcctaagcttggcattaatacaaagggtataattaatgaaatattaaatacgattgggtaaccgaagataactggctcattaatattaaatatacttggtactagtgccattttcgtaatatcacgacttgattttgtttttgaaaataaaagtgtagcaattaaaaggcaaattgtacttcctgtacctcccaacattccgaaggtatctctaaaaacattattgataatatatggtatgtgatcaccagctgcataagcagccatgttcttattcatattaattaataaaactggatctaacaatgttccgttgattactgcttggtgaatcccaaaagcaaatagcaaattacctgttccgtaaattaataataatccaggtaagctcgtattaactcttctcaatggttcttgtattaaagacgtaattaaactgattaaatcagtatgaaatacaactgttaaaactgaggctagaattgcaaataagctcattgtaattaatgctggaatcatcgtattaaatgaaccagctacagctgatggcaccgaatcacttaaatgaatctgaagctttttaatctttgataattttataaacatttcggttgccaagagaccaataataatccccgaaaacatgcctgttgttccaatattttggaatgataaagctcctgtaacattaaccatatggctattcttaaccgtggtagctgttatgttaataggcatcattataattagtgttgccagcgccataattgcagcagttattttattattataatttttgtttcgtgctaaacaatatccaattgttggtgctattaatatacctgctacattcaaagtaccgttcgttatgtaggttccaaaaaattgaaatttagttagagtcgttcctgatactatccaaggaaaaataacattatttactaaaacacctattccagctaagataaataacggcataataattgcgaatgcatcccgaagcgatcgaagatgaacttggttaccaattttgaaagcaatattcgtgaattgatcaataaatttctttttacttagttttgtttccatgaaaacacccctttgcttttagtaaactaatctaaattttcaccgttgctcttaataacttgttttaaccaataaaaactagctttaggaatacgcttcatatcctttaagttatgattttctctatttacataaaccactccgtagcgcttccgcatatctcccttggaacttggtatgtcaattaatccccatcctaagtaccccatgatattagcaccatctatattaactgcatcacaaagggccttaatgtgttctttgtgatatttaatcctgtaatcatctataatagtttgtttttgctcactaattttttcatttacaccaattccattttcaatcgggaatataggtagatttgtttcattagataacttagttaaaacgttcctgaaacctagaggatcaatttgccacccccattcactgctttctaaatatttattaggttcactggcatctctcatataaaaattaggcggtgtattattctttagataaatatgattcaaagtaatcgtgtaataataactaagtgaaataaaatcgtttcggtggctagcaattaattccaaatcaccatcttgaattgtagataacaaattattattcttcaaaaaagttaaaacttcttttgaatatcttccgttaacaaaagcactaataaaattttgatttataaattctgatgcctttcgtgcaataaatacatcttctggatggttagtggctggataaaattcttgataagctaacattcctccgattttagtgtttggaaatttactgtggatataatttgctatttcagcatgtgctaccatcgtattgttagcaatagtatatagagcttcaattgttctttctccgctaacatacccactattatcaaaaccggcttcaaataaatatccattctgctcattaaaactaatccaatatttaacatacttcccataacgatcaataacagatttagaaaattttacaaaggcctctgtaacatatctactaaaaaagccattatattcttcagccagcttcaatggcatatcaaaatggtataagcaaatcatcggttcgataccagcatctaataaggattcaattaacttatcgtagtatctaaatccatcttcatttatatcgccatcaccattcggaaaaattcttgtccatgatacttgaaacctataacaattcatccccatttcctgcattaaatttacatcctcttgatatttatggtattcatcaattccatttttccagtccgaagtatctttagtagctggtttaacatcgtaaactgacatgccttttccgtctaaattccaacctccctcactttgcatactcgaaacggagttaccccacaaaaaatttttctttagtgccaatttattcaccttctcttttatatttaaaataatgatagcgcttttatttttaaatgtaaagtcatttaaaaataaaagataaatcatgattaaaaactcatatgttataatggactggtaaatggcaggtgattaagttggcaaaatataaagatatcgcaacaataattcgtaatcgtattttaaacggaacctatcccacaggagatttactccccgaacaagttaaattatccaaagaattcaaaacatcaagaatgacaattcaaaaagcattagacttattaagttatgaaggattgatttacagtaaacaaggcaaaggtacatttgttaaatctaatgctgattcactatcaaaattagacacaagtattaaccagtacgtaggtacgactgaactttttaaagatcgtgcgattgtaagaagcacagttttaaaaaacgagttacgtttacccacagttgatgagcaagaaaagttacaacttaataaggccgatgcaatatatgacattattagagtacgttatttaaataaagaaccctattgtgtagaacattctattatgcccgctaaaattttaggagatttatctgatgatgttctaaaaaattcgatttactctcatatagagcatgatttagatttaaagataggcgctgcatatcgtaaaatcagcgcggataagccaaataatatggatcaaaagtacttaaaatgtgatttaactgagcctgttttacaagtacagcaaaccgtttttttacaaaatggtgaacctttcgaattttctacaactagacaccgttttgatatgggaagtattacaactataaatatgggaaattcaagatagtgtgcaaaggactaaaaaagctaccctctttaacaaacaaaaaaacactcttattcactaaaatgtgaacaggagtgtttttatattctagttttatttacagaactttattaattgcgatcatcgaaccctcaatatgtttttttaaccaatgtccttttggatagtattaggtataggaatcgttattatctccatttttgctccactaactgttttagtttataaacgaaaataattgaatggaacaaaaattatttttaatacaaaataaaaactccccacttacgctggattaaatatccatcagctggtggagagttttgcgcatctgtagaagaaaatttgattttgagttggtatgttcttatgctgagtgtaaattagtcatcatcaccggagttggcttcgccgccctttttaccaatttctcggtaaaaatctttgtcatgggtgtcggaagtagcttcgccgccttttttaccattcttttgatagaattctttatcgtgagagtccgaagtggcttcgccgcctttttctccaatttcttcgtagaaatctttgtcatgagattcggaagtagcttcgccacccttctcaccaatttcttcatagaaacctttatcgtgagatttggaagtagctttaccaccttttttaccaatatcttcgtaaaaatccttatcatgctttttggcagtagcttcgccgcctcgttttcctgcttcttcacgtgacatcttttcattatccttagtcatattctcttcctccctaaaatttggtttcttctacggttgctatgttaagcgctttcttattagaccacaaactttatgcctcgttttgagaaagtttattttagaggtattttgagtctgaaattgttgacaatatagagtaagatagggacaaatacagttcttggaggtaacgcaaaatggttcaaaaaacttgtacaacaatcctagtcggtaagcaagcatctctcaatggctcaaccatcattgcgcgtaatgaagacggcgatgatgcatctaatccacaacggtttgtagtagttgaccctagtgaaaattcaaaaatttaccactctgttcatagtgaaattgagattccattaccaacaaccggagtacgctatacttcaacacctgatgcagatgcaacttacggtgtttggggagctggtggtatcaatcaacataatgtcgccatgactgccactgaaacaattactagtaacccacggatgttaagtgtcgatcccctagtggaaaaaggaattggggaggaagatatcaccaccctcgttcttccatatatcgatagtgctcggactggcgtgctacgtttagggtcacttttagagcagtatggaacctatgagtcgaacggaatcgcctttgctgaccaagacgaagtttggtacttggaaacattaggtcgtcaccactgggccgctgtccgaattccagacgatgcctatgtgattgcaccgaatcgcttgaatattgattattttgatttcaattccgaggattatctgtatgcagcggatttgcctgatttaattactcaaaatcatctaaatcctgatgataatactttaaacttccgccatatctttggtagttcaactgtcaaagatcagcattataataatccacgggcttggtacgttcatcaatacttagatcataatttcaaaggtcaacccacggatcaagatttaccatttatccaccggagtgaccgcaaaatttcaattgaagatttaaaatttttactgagttcccactttgatgaaactccctttgatccctatggtaccgtagcgcccaccgtgaaatttcgtccaattggaattaatcggaatttagaaacacatattttagaacttcgtaacggtgtgcccgatgcaattgccggaatccattggctcgcctttggtcccaacactttcaatgctttgacacccttctacagtcaagttaccgatacgccagcatgctatcgtgatacaccgttaactacagatagcaattatatttattggattagtcgcattctcgccttgattggtgatagcaattacgctttatatcaaaacttgcaaagtacttatgaacaagaagtcatgcaactggttcgagctgtggaaaaccagactgatcaacaaggggatttttccacaagcgccttagaaaaagctaatcaacaaatggctgatattgtactccaacattcacaaaaacttttaaacgatgttattaatctaggctcacagcacatgaagttgcgtttttcagttagtgattagatattaaaaacgagaggaaaatcaggatttgattttcttctcgttttttgatgtttattatttacagtggatattagtttaacttcagaattgttaagatactcgtattatttctggtaaattctgtaattatttaatatttctatcaagctcttccataataaaaggtggttcaaaaaatatatcgtaccttttgaaacattttttaattagactcatttatctgtttttttgggaatgtaataaggctctccgtagttccttatctgcagcataaatatataatccattaattcctcgtgttaaaaggacattcagttcattaggtaacaacgtatcgtaaattttttgtttctttccattttttaacgtgcgcttattagtggcgtttttattagcactaaaatccggatcataaataactttaccatcccgatactttacagatgggccaattattacagcgctataatttaaatcaaatccctgaatagtatatgttgagcctgcttcgttaatagtttccggacgttcggcccacgataaatacttattagaagatttcaattgattattccaaggtaaactcagaccatctacctcaactttatacaaatcagttgtgccagactttttctctttaaattcccaatcaaaagttgctaaaatcctcgaaagtcctgattcttgattttgattttttatctttagctgctcatacatatctcgtggatcgtcgaatatttttaaatcatatttaacatcattcttaggaaaaggtataatttcttgccgataaacaaatgttttaatccagtcaattgtctcttgactagcattcattcgtaattgtttcttaagctcgattaaattaccattatttttagcattctcttctatttttcttaaatcatcatcttcaacatattgttgtgttcgtagcacttgttgtggatcaaacacagcaattgttatccttgattttttgataatatcttgtaactgattctggccttggtaagattgctttccttgagtccacagcagatgtgcttcatcaaccaaaacaatattgtcttcattctcaaatttatcattaataataaagctcgttggcttcattaccttttcattcaatcttttttgaagtcctagcttttttgctatattgttgtaaactttaacctgctcgtcatgattaactaacatgtatgtattttcattattttcttcagataaagcataaaatagggaacttaataaaactgttttacctgaaccagctgcgccttcgaccaaaatcaattgatgatcgtttcctttatttaaaacttcttttacccgattaataattttatctctggcttcaaattgttccatcgttagtttatgaaaaggtgatgctttaaaaagagcgttatcttcaattactttttctattggaaataaactttgttcattttttctaagcttcttccatgatttagaaaaaatttgattcatttcctcgtaaggaaaatacctatattgtggattatcacgcttattagaaagatttttaataacttcatttcctgtcagatacaacataaatttattctctatatccaaagttagtgatttattaaagtgttcatgacctatcacaaacatatttgaacccttcgcataacgatttccctctctaaaatgctcctttgttctttgtttgatattattagtttccccgacatacacttggtacgttccatttctttcagaataaataatgtaaacagtcggatattctaatagtaattttttattatcgattctctctaactgttttagtccatcttcactaaaaggaacgttcccaattattggagtagaaattgacttttctcttttactcataaaatttcaacctacaattcgaaaaatttacttatccaaataattttaccattaaaaattacttttaaatattctatattgagtacaaatgttgtttctaagatatatatctacttttcagataaaaaaaacataaaaatctcatcgattctcatgctttttttaactattcttcctgtttacgtttttcaaaaacccttccaatccaagccaacaacacatccaacacaacgaatactatcatcataatccccaacaaataatacccgcgataaattttaatttgctgtttaaacggcgccttcttaacctcatacagaacttctcctgtattttctttaatatccagctttcgaactgtactgccgtctttaaagataaacccagctggcgtctgaattgtagcagtctgtccagtcgtagctaggaaatacgttgttgcatacaaggtcgattttttatgcttaccatcgtaatcaacctgattgaaatacaacgttacatatttagtgtgtggtttaaccttaagattaatcgtctgattatatttcttggtgaagatatatgatttagggttatctttcaaagtatcataacccacaatcgaggcgttcgaaatattatagctctgaccgtaaggtgaggtaatctgttccgttcccacgactcgattcgtatccacattaatgtatcgaatcagcgcatttctcaaccatggcttattagctggtaggttactattatccaacttagtattcacactctttggtgctacttgattgttaatcgaccgtacatatttaggtttctcagtgatttgtgggaacttgaagtttttcaacatcttggtcggttcaatatgtttatcataaaatttttccacctgcgtaattaatggaaaatctttttgaggcgtttgccgaactggcaccgagttgtctaaaataattcgatcaactttccaataccacgccatccaagtattagcccacaattttttatttcctggcataatgtatggtgttccatcatatggattgtacaaatccgttgtaatttgaatccctggcatgtgaacaatctttttaccctttgctcgaacttctttagcaagttgttcgtgagtataaaatacattgtatgattcttttaagtttgccaaatgaaactgatagcttggaatcccaagatatgttaatccagcaacggccaccactaaaactactgaagtgaaggcactatatttccgcataatttgccaagcttcaaaaaagttaaataacgaaattatcagtagaacattaacagcgaaccacaaccgtgggaataagactggcgaaataatcatagctcccactccagctaatccactaaccaagaaaatcatcccactcaaagtggcttgttctaagcttgttaatgtttgaggggcaaaaattcttctaaaaagctgacgctggctaaaaacaacatacagtcctagcatgaacgttactagcaataatggtcctgaataagcaactgtatctaaaataattttagtgagatggtatataaaaccatcccccttgccgtaattcttagtttcagctgaacccgatgatatctttaacatacaaataaaggcgactgcattagcaactgttccaaccgtcttccaccatagatcattgaaatcctttttggaacggttaaagaagctaaaaaatccaacaaccagaatcgacgttgaacttcccacttcattcgacataccaactaaaacgcccaatatcaaaacaaaccatgccatgatgttatggtgtttttttacatgataatcaaaacgatatggcataaaaaagcctagcatcaagactgctggccacaagtaattagaggtcccacttacccacaatactgtacttccaaagccagctaaaaagaaccacattaatagatagattgccaattgtcggagcggacgaaaaatagcacgtttaccgctggttaggatattaatttcaaaacccactaccagataaactaccgtattaacgatattaatgatccatttaggaaattgcatggctgcaatctcaaaaacaatcgaagtaaagcgagcattccactgcgtcatatgagtatgaatagctcgcatccaatcgtacaaattatgatattcttgagggccccctttagcaggccattcgccttcatacacaaaatggtataaaaaatcatctccagttaatccagcaaacttatttatattcaaaatatatgtaaaaatcacagccatcacagccaaactgccaacaaataacgccccatatttgataaatttactagcttttttaaccatgaccaatctacccgcctaccacagacttcctccttcaaattaaccctatttatatttaacgccctagttgcgtatctgcatttttcttacgacgttctaattcttccgtcttttgtcctaattcgcgcttagtttgttcaacttcatttttcaaatttttaatttcgctatttttcttcatagcagaactcatcgacaatacaaacatgaaaaaggcaccaattaataaacaaaccaaaatcaataaaattagtggcatcttaatcgtcgtaaataaaaagttgatatctgtcgccgccgtattagctaacgccaataacgcaatcaaaataactaacacaatgctgataataatatatacttgtctcttcatcctccagaaccccttcattcctcaatttaattaaatatttatccactttaagaatagcataggtttaatctgaaatttagctggttatcatattggtaaatattttttaggacctatcaattacctcactattttgttactaatgctttgggctatttcacaacaacgaaccatcaaaaaaacgttgaatcatcagcttaactcggcttagattcaacgctttttattagtttattttagattggagccaattaacatagtccgattcacgttcgattgctctggataaaatcaaatagtgtccgtaattagctttaatcgccaattcatctccaaataataattcttttcgagcttttaaatgaactaccttttgttgatgcaatgccaaacactgttttaaaatttgttgcaagattggggctcgttgatctgaaatacaataaagtttcaatgatgttaattcatcattctttaaggtaatcggttcggcaagccatctttttaacgtctcttgccctttagcttcaatcacgtaattgatgaccttccgatccttaacttccacatcttcagccaccttaatctgcttttcatccaccatccgttgtagttcgggatagagctgactatgtgataccgtccaaaactcacttatatcagttttaaactcactaatcatatctttaccagacatcattccgtttttatttaataatcctaaaataatgtacggtaaaactcttggtcttggcattattggtttctctccaaatctaaactttatttgttaatgcgtttgtagttttcatcaaagtacttaccagcgcggatgtcgtcagtcataccttcgtatggagcttcggcaataacttcatcgttgtcttggcctgcatcacccatataagtaattgtagcaaattctgggacaactagcttagggtaagtttcatatttttcacgagattcttccatcaaatcgatgtgttcattttggaaagtaaccgtgatttctggatgttcttcaacccacttagggaagaaaatggttccattcaatttcttttcattaggaacaaagtctaaggctacatcagtaccagttggttcagtccaagctactttgtaaataccttccgttaacatagcgatatgagcttcttggtcttttacccaacgaccagcaaccattccaccatgaattcggtaatcaacagtatgatcatttttagcataccattcgtattcccaaccattatcgtatgtgtaaataaaatgtgttcctaaaaagtcatctaaagttttaaaagttttttccatgattttttacccctttgtttttacatttatgttgttatcaatataaacaactatatgacgataacgacataaagtcaacaattttgtttataaaaaaagagtaatgcgcctaaaagccaccattatagggctttttgcgtattactcttttataaatttcagtaactataattcatttaagatatcctttatttcacaaattaattcgtttatatctgtattattctttaaaattgataaatgtttttttaaataagggtaatctataatattattttctacttcttcgaatatttttttggttgcccctccagtagatccaataggtataatttttttcccttgttcttttgcaattctaaactcctcgattagaccttcagataattcttcctttttatcttttccttctctatttccaaacataaaaataacaacacctacaccatttaccatttcactacgatacattttttgcctcacatcattaccctggtttacagaagaattattttgaggaaatggccgtaaattaagataatcatctacatgtttgtacttttcagaataaattacctcaagcgctccatttattacgctagagcccactccatatccaaatcccgagcaaatttgatagttatttttcaccaattctttcgctagagagtaacataaagcattcactttttcttttgtccaaattttgtcataaaatgtaacgctacctgaaataaatatttttctttttaaattcagaaattctaattcttttaaaatttcagtaatctcttcataagaatcaatatagactgtttgaatcccataacgttgtaattcatgaatttttaattcttatttcgttctgtcgacttcataacgtactttagcttctgttgattcttctatatcagaaggtttcgttactcttttctctaaccagtagttattactaatattctcatccaatatatttcttgtagctgctaaaacattagtcaaattaggatcttcaaagctgaaaccaatgaaaagaaatgtttttgagattaaatctccttgaagtatactggtgaatagtgggtttctttgattataaatttcataatcttgtttagttaaaacagcctcagctggatcatctacatcgccatgcatcttatacaagatggcatctctatcatatttttgcgttgataatcgagtttctctacattttacatcaacttttctattattatttttaaatcctccttctaataacttatcgtaattagttgtccaatatgtataaattggtagacgagttaagatatcaatattttcatttggttccttttctttcgaaaaggcttccataatcgtttgatttatatctcctctacttttaaattcatttctgtagtattgtgcaactttagttaaatcattttcttcctcaatatttaaatttagctcttctgcaaggggagttactagcattttccaatcaacatatccagatgctacagataaccctgctccagcaaaaactgcagcatatccttcatttatggctttactatattgctctataaaactttttctactagtaatcattaatttcctcctctaaaaaacgtatgctatctcttcttacttaagatatatccctcagaatgcttacttttttcataggcgttttcaatgtaaaagtttggatcatttaaaaaatcttcttcgtttatcaatgaaatataagatcctactagcatatctacacatttgcaattttcacatgcatataccttcggctcctgattaaatctattcttattaagaatgtcatacatatatttttcatttgtacccaaggttgaacacccatcaaatttatcatttcttggtctcagccatgtataatccccgttatattttttcacaactccaacaatcccatttgtacctgatgaaaaatcgccccgcttaacttgttttaacgaatattcaatctcccaatctatccattgactttttatcatatttggtgaaatgactacaatagtcacagatgttgaataaatcatatcttttaacttttctcttatataatctgttgtcctatctgtcatatcaggtgaatcacttgtttcaccagtatagtaggtagcatcttttcccatagattcgattatggaatcacgtaattctctagcttctgaatacttatacgaaataaacgtttttctcgccatatattttctcctaaataaatttatccaatactatcttccatttgaaacttaattagccgatctaattccaccgcatattccatcggtaattgcttggtaaagggctctagaaagcccatcacaattaactgggacgccgttgcttcatccaaaccgcgactttgcatgtaatataattgatcttctgcgattttagagacatgggcttcatgttcaatcgttccatcactagtttcaatatcattgactgggaaagtatcgctagcactatcggggtccattaaaatcgtgtcacattccacatgtgatttagccttggttgcggctttagtgtacttaatcaaccctcgataatctgctcgaccaccattgtggcaaattgctttagaaacaatggtactgtgcgtatgtggagccatatgaatcattttggcgccggtatcttgatgcatattggctccggcagccgcaattgaaagcatagaacccgtagctccttggccaactaagtaaatgctgggatatttcatcgtcactttagaacctaagttaccgtcaatccattccatcgtagcgttcgtctcagcttgagcacgcttagtttctaagctatagacgttggtcgaccagttttggatggtggtataacgacaatatccatcttttttaacaaaaacttctacgaccgccgcatgcaaactatcttcggaatagttgggcgccgtgcaaccttcaacataattaacactcccgccttcttcaacgatgatgagcgttcgttcaaattgaccagttcttccagcattaatccgaaaataactttgaattggaatatcagcatgaacattctttggtacatacaaaaaggtaccacccgaccaaaccgccgtgttaagtgctgcaaacttattatcatcagcaggaaccagtgttccaaaatattggcgaactaaatctggatgtttctgaagcgccgaatcggtatccataaaaataatcccttggctttccaaatcttttttgagattactataaatggcttctgattcatattgtgcagcggaacccgccaaatatttacgctcagcttccggcacaccaatccgctcaaaagtagccttaatatcattgggaacgtcttcccagtcccgagcgatgtgatccgtagcacgttggaaatacttaatttgatccaaatcaattccattcaaatcgggaccaaacttgggcatcggtaagtctaaataggtttgataggctgccaacctaatttcaagcatccacgccggttcatttttagcctgcgaaatctgcttgattgtttcagcatcaattcccactcctgttgaaaaaacgggggcgactggatccatcgctccacgttcatcccttaactggtctttttcaaactgtggattttcactttccaaagctgattcctccttgattcaatccatctgccattgcatgccatgctaacattccacaacgaacgcgcgttggaaattggttgagggtcgcaaatgcgattaaatcgcctaattggctttcatcataatcttttcccagaatcaagttctgaaaattttgcatcaattgttgcgcttctaaaatacgcttgcctgataaaacatctaccatcatgctggcggaagcttgactgatgatacatccttgtcccgtaaaactaatctgtcccaaacgctgatccaccaccttgagataaacctcaatatcatccccacaatcaggatttttcaatttagcgtggtaattatattgcggtaaaactccgactccgatcggatatttagcatgatttacaattattttttgataaagctcttgaatatcactcataataaaatttgacccacctgattcattgctgctaaaagctgttcgatatcctccgtcgtgttcacatacgaaacactggctcggacgacgctacttactcctagagcttgcattaaaggttccgcacacatatgtccggctctaaccgctacattttcggtatcaataatggtcgctacatcatgggcatgaatagttccatagttaaaactaagcaccccttggcgctcggctacggattgtggaccataaactttaattgctggtatctgctgtaatccttggtataactggtccaataattgctgttcatgttgttgaatggttgtaaacccgatcttttgtagatatcgaatagcagcccccaaccctaaaactccggcaatgttaggcgtaccggcttctagccgtagggggagcggttgaaacgtcgccgtttgagcatcaacttcatcagccatttccccgccaaagcgcaaaggttcaacttgttctaacaagttccgttttccatataaaactccgactccggtaggaccatacatcttatgtccagaaaaggctaaaaaatccgcatccaatttttgaacatctaggggtagatgaccaactgcttgagcagcatctaatacaaccactccccccatatgatgcgtttgttcaataatttgcttggcatccacaatacttcctagcacattggaaactaacgtaatggcgactagcttggttttctccgtaagcaattcggaaaattgctgcatatctaaattctgttggtcgtctaaaccgacaattttcaattttgcgccagttttacgagccacgcgttgccacggaatgaagttcgaatggtgttctaaaacactgataataatttcatcgtctgattgaagttgtttttccgcataaccaaaagcaactaaatttagggcatcggtcgtgccactggtaaaaataatctccgaggagtcctgagcattgataaaatcagccgtggcttgacgaactgcttcatattgttccgtaacttggtgagctaaccgatacattccccgatgcacattaactttatgggcatggtagtacatatcaattacttccaatacttcgtctggcatcggcatagtcgctgcattatctaaataggctattttttgatcatctatcattgtttaccaccattacttttccacagtttcttttggtaaaacaggttccatgaaattattgattaaaatttgtttagcatccacctccgctaatccccgacttaaaagatagtacaacgcttcttcatcatactgtcctacactagcagcatgaccagcttgcacatcattttcgtcaataattaacaagggattaacacttcctttagcatgcggttcaatggtcattaaccggctttcttgggctgcattagctccatgggctcccttattaatcttaccgatactagtaaaatacacctgggccttttcatagagaactccccgcattttgattcggctaaatgtcttaggagcacgatggtcgattaatccttggattccaatccaatcatcccgacgaccaaattggcccactttgaatacagccgagcttccctgttcttcaagcaccgtgatacattttccaagtactttacccttcacctcagggtaaaatgaccaatctaactgagcgtctttttgacaatgcaagtttgccatccataaactttgctgtggcgaccgtccgccttgtaaccgatcaactaaatttaatcgactatcaacttccacttttccacatgttaataagttaagccgggtgctggctggtggataatggatttcgcgttctaactgcatctgacttcccgcgccaacgttcaatagcatggtaaaagcggaaggttgtgctgcttcgaagatgatttcgaggtgcaacttattttttaaggtcacccgtgccggtaggatcagctcaagtccttgccaaggttgctgggcatgttctaccataaattgattgtccacattagcttgcaattcgctttctaacaattgttttccggcagtactaatctgctgggtggggccgaaagtttgaatcctgcctcccgcggcctgtagctcttgtaaggctaatggattagctttccacgaccacttcgtcgttgtcatcgatgcatagctaaaatcttgaggatcatatttaatccccataattttcggatatttagttggcgattctaattttgtttcaatcgttatcgctcccctccactgcatcacttaaatcggcataacccgttttttctagctcttgggcgagttctgggccacccgttttcacaattttaccgcccatcataatgtggaccacatcaggaaccacatagtttaataaacgctgataatgagtcaccatcaagcaactaaattgatcacttcgcattgcattaattcccttagccacaatttgcaaagcatcaatgtccaaaccagaatcaatttcatccaaaatggcaaagctcggtttcagcatcatcatttgtaaaatttcattgcgtttcttttcgccaccagaaaaatcagcgtttaagccccgatcagcgtagtcttcatcaatttctaaaaaattcatttgttgttttagttcatttaaaaacggtaaaatggccaccggttgatttccattccgcgcatttaaggccgcgtgaataaaatcagcgttcgaaattccggcaacttccgtcggatattgcattgctaaaaacatccccgctcgggcacgttcatccacactcatagttgtaatgtcttggccatctaaaaagattcgtccttccacaatctgatagagcgggttgcccatgatagtctctgatagggttgattttcctgtcccatttggacccatcaatgcatgtacttcgccagctttaatttctaaatttactccgttaagaatgggttcctcttcggcaaccacctttaaatctttaattaatagcgtactcatcctatatcatccccatttatcgaattagcttatcccaaataattacccgattttcttttaacgatttagggacgtcaatgattctttggttggcacttccccgaaactgtaagctcaaatccttttcagcttctaaaaagcgtccgtccaccaaaatatctaaataacttaatagttgtaatttatcatatgattcttgcatcagttcgtcccaagtatagccagtccacgaccaaatatctttttcgttaccaaattcagctcggattcggcgcaccaaccgcaaacaaacttgcgtgttcaaaaacggttctcctcctagcaacgttaaaccttgtacgtaactattagcgaggtccttcataatttgatcttccaattcatctgaatagggcgtcccataatggaaattttgcgcagctttgttataacaacccggacaattaaacaggcatccggaaacatacaagctacaccgaatcccttcaccatccaccatgttaaaaggtttgtagtcggcaatgtattggagactacgatcagctgccaaccaggcttgtggttccggatttttaggtaaacgtactggtcgtgatttattcattggcttcaccttgacccatatgtttaacccgtgatgcaatttctttatgacgaccatggaccatcggacgaatcattggattacccaaatatccacaggttcttttgactacatcacaagtcttaggatcacgattgccacactgtgcacattcgaagccccaggcagtgggtttaaaatcgccatcataaccacatttgtagcaatgatcgattgaagcattggtccctaaataaccgacatggtcataagcccaagtccaaaccgcttctagcgcagccggattttgttttaaatttggatactcacagtaatgaataaatccacccgaagcgtacttaggataggcttcttcaaaacttaatttttcaaatggtgtaggatttttacgcacatcatagtggaaactgttggtgtaatattctttgtcggtaatgtcttttaccttaccaaacttttcaatatcgtcttcacaaaaacgatccgttagtgattcagctggcgtggaataaacgctaaaatgatagccatattcgttttcccattggaggcagtaatcatgcaagtacttaacaatttttacggtaaaatcatgagcttccggattttgttcccaatcggcgccaaagaaagccgtaccgacttcatataaaccaatgtagcctaatgatatcgttgctcggttcttgttaaataattcatcgacctcgtcttcgtcttggagacgtttgccaaatgcaccatttttataaagaatgggtgcattctgcggctgtgcctgacgacaacgtttaattcggaataatagcgcgcgccgagcggtttcaacgcgatcttccatgatttcccagaatacttggcgattgcctttagcttccagcgcaatgcgcggcaaattaatggttactacgcctaaattcatccgaccattattaacttcatttccgtttgcatctttccatgcttgtaagaaactacggcagcccattggagctttaaagttccccgtcaattcgacaatcttgtcgtacatcaagacatcggggtacattctcttagtggcacattcaaccgcaagttgcttaatgtcatagttaggatcaccaatattgagatttaaaccgcgtttgattgaaaagaccagtttaggaaaaatcgcggtacgatgctgcttacccaaacctttaatccgaaccttgaggattgctttttggatttctcgttcaaaccaggaagttcccaatccgaatccaaccgtagtaaaaggtgtttgcccattagatgagaacaaagtattaacctcatattctagagcttgcattgcatcataaatatctttaaccgtttttgctttagcaaattcgtcccggcgaccttcttcaacccattcttcagcttcttttaaatgtttttcataatttaatttagcgtatggagcaagcaattcatctgctcgatcggccgaacaaccaccatattgactagaagccacattagcaataatctgtgacatttgagcagtcgccgtttggattgacttaggaggttccacatctgcatttccgatcttaaagcccttttccagcatccccttaaaatcaattagacaacagttggtcatcgaagttagtggagaataatctaaatcatggaaatggatatctcctcttaaatgagccttagctacaatttcaggcatcatagttaatcccactgatttacccaccattccggcagtcaaatctcttctagtactaaaaacattactatctttgttggcgttttcatgaaccaccatgtcatttccgttaaaaagctgattaagtttgtattgtggatcaatggcggtcttccattttttaatatctttttcacgataagcttcatactgttctaatagttcagcttgattgtttaaacgcaaaatttcttgaaaaacttgtctaatatcggctgtgctgatgttgtcgtccccatcagcaatacgattaaaaatttgttcttttaagctgtcctggagcgccacatcagaggttaatgtttctactactaaagcaattttataagggtaaaagttaacgacttccccatcaacttttgtcaccttcatttttttcaaattttcaattttggtacttaatacagttttgatactatccatctaaaattcaatcccctttctaccaaatccccataataggtccaaccatgtataaaccgaaccccatcactaccatgcacaaaaccgtcactaaccaacgataaactccgtgcatgcgatatttttctggtaaaactttcgcttccagaattaacaaaaagcctaaaacaattggtaaaagtaaagcgttcattacttccactgaaactgctaaattaactaaattgatgttagctaataccaaaatggccccaataatatgtgccaagcagtaaattatgtaaaaccctaaacttcccttttgaagcggttcgtttaaactatgtttccaatttaaaacctcagtaacgccccaagtgccggctagggctacgactaacgcagccactaatgatccacctaataagctcatccccgtaaataatttagccggataacttccgataaatgtacttaaaccactggctaggtcactgaccgtttctaaggccacttgctggtgctgaagtcccatcgtcgccgcaaaagcaatcacaaacgtcaacataattccttgcgttaccaaggttcccacaaaggtatcgtgtttttctttgttaatactttccacgcctaaatttttgtcgactacggctccttgttgataaaaaatcatccacggcataattactgctccaacattagcagccactaaataaatataggatgaattatgccatggaatggtaccaataccacgcaccatatcgcccagttgcggtttgaccattactaccacgactaaaaaagccaattctgctaaaccaatcatgacacctactttttcaacccgtcgatagctgccactaaacgcgatggcaatcagtaaaacggtcgcaatgggaattgtaatccatttggaaatgccaaacatttcaccaactccggcaatccctacaaattccgtcaataatgcgccaatagctgaaatagctagggttccagccgaaatccaagcccacttcttaccaaaatactctcggattaactcaccatgtccctttttagtcacaattccgagacggaccgtcatctcttgcgcaaaatataagactggaatcaataagatttggggaagaatcattgtatatccccattgagctcccgactgagccgcagtgatcaaacaccctgcatcagtatcagctaacatcacaattaagccgggaccccaaacattaaaaaaatgtttcactttgaaatatgaggttgattgataacctcgatttaagatatgattgatgtcgaatgttctaactctacgcattcattatcggtccttctttctgttgataattcaaataaccatatctaaagattactccgaaattttttaaattcaattcttgaaaacacaacatctatgtgcttattcatatgtataatacaatatatagtatagggtatccattaaaacgccttgtctgcgcgttttgctggataccctatttttcttaaaattaatcaaaaaagattggcatgaaatctaaaaaaatgttcttcaaagatttaaaaatcttgaaaaacattttagctggttgaccttcatggcgctaaaaaatacaccaaaaattagtttgttcatgcattttaaattacgcgtttaagataatttttttaatttgtttaaacgaattggccacataagtaggttggtaggattgaactaccggtaatgcttgaggattgtaccaaatactgtttaattgtgcgcgtttggcgcccaaaacgtcggcttgaagccgatcgcccaccatcacggcattcgttgttaaattcccatattttttaaacatcggttcgaagaaacgtttatccggcttagcaaacccaatgtcttctgagatgaaatagtcttcaaaataatgctctagtcctgaaccttttaagcgacgaagctgcgtctctttgacgccattagttcctactagtaaatggacccccgccgcttttaaatcgcttagaagctcatctacgccttgtagtttgtaaaaattagtgtctaagctactacgatattctgcctccactgctgctccgtcaactttaattcctaataaattaaaagctttggaaaagcgcgtattcaatagggcatctctagcctgaccttgttcgattgcttcccaaacttgatggttaattttggtgtatgtatcaaacccctgcttcaggtcagaaaccccatatttagtcattattttggttaagccttctcgttctccccgtttaaaatccagtaaagtatcgtctaaatcaaaaattgcatatttaatcatcatttactccattctaaaatacgatttaaaccccaaatagcaaacaaacgtttgtgtattaatacattgtttaatataattgtataagtaatatattgtctattattaatgctttattatatagaaaatgaaacggaacaggaagatgccaaaatctaaaaaatttaaaccccttagaattttttctaagtcaaacatcgtaattgtaattttagcggcccttggaattcagacttatcctaacttaaccaacaaccaaatggctaaatcagattccagtgattataccacagatgatgcgtctgatagtgcaacggtaattgaaaatcaaattgccaataatattaattcgagaattccttttcagatcaattttacggacaataacattattattaaagtacctaaaatcgatatctttagctttactagaaactacgtccccaatacgttagcagttctaaaaagtatcaaaaacaccaagttaccgacctctgctaaaaatgttaagtttttagtgggcgatgatgcgcaaatcttctccgtcagcgccatcaaaaaagctaatttcagtgccaagaaaattaaagaatttgggactagtgggacggcgtcggagattaccgctaaaacttaccaaaattattatcaacaatatatcgtgcctaaaatcctcaaataaaaaagtaccgtagaaaatttaaatttttctgcggtacttttatttatttttatctgaacatagtcttagttgcttttagcaagacttttggatctttttcatagtgatgaaccggcgtcatttgtgattctggaatacccatgaagtggtaaaccgccttttgagcggctctgattgagtattgttccgtaaagaccatatcaaatggcatttcagcaaattgactaacaaaagccaagttcttagagttctttggtacaacgtctggacgatctcccaccgcccgttggttgaacaaagcactagcatatggcatgtaaactggaataacattcacgatactatccatgatttcttcttcatgattgataatgttgtcagctgctcgatcaacttctgatagatgtcctagaagttcttgaagcatttctttacccgtcatttcgatcactggtttatcaacataatcaccatttttacgtgggaacatgaagtaaccccagaagactgtttcattttccttttgggcgtggaaatgaggttggtgatgcaccacaatggataagaggttgttactatctacccaggtatttagcgcattccccggttcttgttgggtaattcgactaatttcatttaccaagtagtgattattggtagtaactgtgaaactcatccattcactctgggcccgatcattaaagaatttatcaggatttccaaggttataaaaatgttctgtagcttgtttccaaagggctgcacttggagcatattccatattttctttaaccggcgtgttgaaatcacccattgatgaactatccgtaattgctccattaatatcaaacactaagtcattttcatcaacttcaatttttccagtttcaccgctctcaacatcttcatattcaagtcccgtaacgataatatcatcacggagcggtgtgtctttgaagttaaatgccgtaatttttcggttattaataaattcaacgccttgatccgcaaggtattttctcataggtaagataatactttcaaactgattgtatggtgtacgagttaccccttccaaagtgttgattcgactgaattctagaatcatccggttcatgtagcgccgaagttccatagccgagctttccttcttgaaggcaaaagtagtttcccacatataccagaagttagttgaaaaaatatgaggactttcagcgaaccattctgcaatgctaatatcgtttaatttatcttccttactctctggcatcatcattaatttagatagtaagtagcgatctttattattaaactgcatccgattatagtcgtctgctccaccgttgttacgaatcccattcttcttatccatcaatctagcaacatcatgagtgggatgtgcatgatcgaaattcaatatatcatccgtaaccgattggcccggattgtccaaagatgggacactccgcaaaatatcccagagattttcgtaagtttcttcgtttaacatccgtccacccttagctaaatagcctcggttgttagacagactttgatttccatattcttgctcatagtcggtgacggcagctccatcattggcaccatgtttttctaaaccaaacatcgtaatctggttaccagaccacccaccatcgcgaatcaaataaatacctgctgctaaattggcaattccagtaccgatcatatatgctttttccataatatgtaccctcctgtgctcaaaccttgtacagtattcttatatttaaattcatgaatataatagcactttatccgtcataatgcgaatattttgcaccattaatttttatttactattactaaaataaaaggccagcttcgcgctcctgctaagttgcagttttggctccaccgacctttttataatttaaccactaatatgattttcatgaaggatcgcattaaattctttcataatccgatcgtctttttgccattcttcccaagccgtcatggactcatccggcatctcgtagcgctccccaatatacttttcgtaattaataacatgttgggaatgtgagatatttaattgcaaaattcggacagatttaatataaccacgttcggcggctaattcagcccgaccattcatcatcatatttccaatttcaatatatttagttccgtctaagcgcgtaatctcttggattagcgtaaatgtttcattactcttcattgctctgcctccacttctactagtatagtttgccgtaggaggtcgtgtctagtcactctttagacaacaaaaaaggatcctgaccttttgatagtcggatccagcataagagagaaagagaattgattgtacaggtaggagatgcgccactaccttacacgaataatgataacgcttacaactataggtgtcaatactgtttaacaatttatccaaaaaaataacgatacaggctagcacctgtatcgcttattttagatattaacttttattcaaccgtaacactcttagctaaattacgtggctggtctacgttatatccacgttgcaaactagcataataagctaataattgagcagctatcacactaactaatggcatcaacatctcatccactactggaagtaagatatcatctgtagaattagccaaatcttcactaaccatggtgatgacgttagcgccacgagaaagaacttcttgaaggttactacgcgtatgatccgccgtcttagattgcgtaataattccaattaccggcgttccatcttcaatcaaagcaatcgtaccatgctttaattcaccagaggcaaaaccttccgcttggatgtaggaaatttcttttagtttcaaagaagattccaaggcgacattataatccaaacctcgtccaatatagaatgcattgcgcgtttctcgtaaagttgctagagctaacttttcaatcttacccttctcatcgaccacggtttgaatggcattagcaaccttactcaattgtcccgtaatatcaaaattgacagctgtagaattagccttttcacgtcccattgctactgctaacaaagcttccactgcgatttgcgctgtatatgctttagttgaagcaacggcaatttcaggacccgcttccagtgtagctgagaagtccgcttcacgagccaacgttgagttagcaacgttagtaattgttaggctgggcttttgccattcatcgtttactcgaactaaaacttgacgactatcagcagtctctccactttgacttaagaagataaagaaggcttgatcttcaatgataggatcgtcgtaagcaaattcagaagctaataccacttccgtaggagttttggtaaacttctcaaataacttcttacccactaatccagcatgataactagttccagccccaacgatgtaaagtttagaagcttggttaatttgatctaacaaagcttgatcaaagtgaatattgccggagtgatccagatatttagcttcgatacgacggattacagcaggttgttcatcaacctctttaagcatgtaatatggataagtccctttatctgcgtcagcttgatcaatatcaacagtgaaaggagcgcgttcgatcttttcgccggctagattactaattgaaatgctttgaggcgtaatcttaactacttccccgtcgtgcaattcaacaaattggttagtcacgttaatcattgccaatgcatcactgcaaaccacattgaagtcttcgcccactccgattaacaaaggactcttattcttagctacgaatagggtttctggtaattgacggtccatcaaaacaaaggcatatgatgaatcttttaataaactaattgcttttttgaaagcttgttctgtatccatccctgctttagcgaaacgatcgataagttgaaccacaacctccgtatccgtatcgctttggaaagtaacttcagataaatagtcttttttaagttctttgaaattttgaattaccccgttgtgaactaagtaaaaacggtggtcttctgaaaaatgaggatgagcattttcaatacttggtaccccatgtgtggcccagcgtgtgtggccaatccctgtggttcccatgacatcatccgtaattttttcctcaagatttttaatcttaccttgagctttaactagatgatcttcaccattagcattgctgacataaatccccgcagaatcatatccacgatattcaagttttttaagtccatttactaatagattggttgtatcggctcttccagtaactcctacaattccacacatactacttgcacctctaaattaatatattttaatttttaaaattggtatatagaacgattattaatatataacggctttattgaattgtcaaacgttaatatttagaattggtatatatcaaatgctgaaataggtatagtagcaatgcttttcgcgtataaaaaaactatgccattttttgcaaaatagcatagtttttaaatttatttagttgtagaagttgaattcaactgattaatccacgccaacttcacttcgaactacagcaacaattcgatcaacatattgaccaactgcttcttctgtaggagcttcggccataatacgaagtaaatcttcagttcctgaaggacgcactaggactcgaccttcgccgttcatttcattttcaactttttcaatgatatctttaattgcttgattttcaagtgctagcttcttatcttgtactcgaacgttaactaatttttgagggtaagttgtcacatcagcagctaactcagacaactttttaccagtttgtttaaccacgtacatcaattgaatggcagttaacataccatctccggtagtattgtggtctaggaagacaatgtgtccagactgttcaccaccgaggttatatccgtctttaagcatttcttcaaccacgtagcggtcaccaacttgggtcttaaccgagtgcatatcattggcttctaaagccttatatagtcctagattactcatcacggttgtaaccacagtatcgtctttcaaacgtccacgttcgctcaagaatttaccacagatatacataatcttgtcaccatcaacgatattacctaattcatcaacggcaatacaacggtctccgtcgccatcaaaagcgacccccatgtcagcgcctttttcgaccacaaacttagccaatccttcaggatgagtagaaccaactccagcgttgatgttcaagccatctggatttgttgccatcgtatcaaactcggtgtttaagtccgcaaatatttgtgaaacgtagctgctggttgctccattagcagcgtcaattgcgatatgcaaaccttccaagtcatcgggaatagtttgttcaagaaaggccgtataatttaacccaccttctggataatcagtcactgaacctagtccagtagatgaaggacgaggtaagttgtctttatcagcatctaaaagtacttcgatttcagcttcaagttcatctgatagcttgtaaccatctgaaccaaagaacttaattccgttatcttgaaccgggttatgtgaagcagtaatcattacaccagcatcagcttcttgtttacgaacaagataagccacaccaggagttgtaacaattcccatgtccataacttcaatgccgactgaaagtaagcctgagatcaatgcgtgttttaacaattgtcctgaaattcgggtatctcttgaaaccaaaacccgtggttgttcatcatctttagcatgcttagttaaaacgtaaccgccagcacggcctaattgaaacgctaattctggagttaatgtttcgtttgcaattcctcgaactccgtcagtaccaaaatactttaatttcattgttaataatctcctttgttaattcacctgtgtatctgtgtttccgctagcatcagatgtgcttgtactatcggaagttgcactatctgaggtcgtttgagctgaagaattagtggatgcatttgaatcggtctgggcagattcatccgtggcactggaagcatctgaactagattctcctgagcttgatttagagttacttgaactgctagttgaagctgaactttttgctttagaagctactttcgtaactggaatggtaacatttaccgattgaggcgttaacaccacgtttacaatgttaccgtttacgtctaaagcttgcaatactgctcgtgcagaaatatcttccgttgtgttgctaggaacattaacatctgcgactacttgagaaatgcgttcaatatctgtagctgaacctgtggcctgaacctccgtagttgaggatttaacatttcccatggtgtagccttctttgatcatattggtatcgtaacgatatcgaatttcaaagtttttagtccgtcgtctagcaatcgaaatcttagctaattcgggatcaatcttatacttaatatcttttcccaatcccgtaactttatacttaactgtatattttccagccttataatcttgtaagtccaagtacaccttgaaattacgcgtgttagttaaggttgttaccagcgcactggttccagacaaagtcacctttacgttctctcgataaccgctcactacgtacttagaagtattaacatccaagtcgaccggcatggtgatagtagtcgtcttagtcgacatcaaagccgaattattttgattagaatcgcctcccgaggtgcgggttgcggttaaatgatctgtctttacgtatgcaaaaagtaggacggctaacactagcgcaattaagcgatatcctaagttttgtgtaaaaagttttttcacttagtgtcgccccctttttcctttaaagaacgacgaaatattttctgtaacagaagcaaagaatggtgtcggtccttcatcggtcgtaattaattgcgtacggaaatattttagatacgactcttgtgtcattccgcgaattaattcaccatctttcataatagaaacttcaccagtttcttctgaaacaacaatggtaagagcatcggtaacttcactcatccccacagccgctcgatgacgcgttcctaattcttttggaattaagttactttgtgacaatggtaagtaggctgctgctaccgcaattttatcatttttgataataactgccccatcatgcaaaggggtattcggaataaaaatattaattagtagttctcccgaaacatccgcgtctaatggaatccccgtttcaatatagtcatctagccctgtatccatttgaattgatattaaagccccaattcgccgcttagccatgtattgaatcgctttatccaaagctttgatcaagctttcttctgcttcattttgtgaatgattcttagcaaaaatcgaaccccgaccgagatgttctaatccccgtcgaatctccggctggaagataatcaccatggcaattacgccccagttgatgacttggttcatgatccaatacacggtacttaatccaatataccaactaccaaccataataactacgattacaattattccacggaatagctgtaccgccttggttcctcgaagtaacataattagctcgtaaattacaaaccaaaccacaattatatcgattaaattgatgaggttactccatgttaatagttgggaccaatttatatccataaccgtccctccaaattttattcaacgcccattataccatggacctgccgttctttatggtcttttcgaacaaagaagagtttagaaaatcaaattatttttctaaactcttctaatatataccaattaattatttctcttcaccgataattcgaacttcggtttctagcgttactccaaattgtttcaagacggttgcttgaacatgatgaatcacatccatgtaatctgttgcggtggctcctccaacgttaatgatgaagcccgcatgtttcattgaaacctgtgcgcctcccactgtaaagccttgaagacctgcctcatgaattaattttccggtaaagtagcctgttggtcgtttaaaaacactcccacatgatggatattcaagaggttgtttcgaagctcgcaaacgattcagttcgtccatccgagctcgaattttgttagcatcccctgaacgtaacttaaaggttgccgaaagcacaacatcttgataatcttgcacactactatggcggtaaccgaaatcgagttcatggttatttaactttttaatctcgccatctctcgtcaaaatttctgcgctagtaactacttcactaatctcaccatcataggcacccgcattcataaagactgcgcccccgattgatccaggaataccagctgcaaattcaaggcccgttaatcctgcttggtaggctacttccgtggtctgaatcagtgccgcacctgcttccgcaaccacttcatttccattgacctggatgtcatccattttagttaaaattaacgttaaccctcgaataccaccatctcgcacaattaaattacttgcattaccaataatggtcaatggcgtatccgtttcttttgcccaaagtactagtcgtttggtttctgttactgactctggaaataccaacaaatcagctggaccaccagtttgggtattggtgtattttgacaaaggctcatgctctaacacttgaacctctggaaatgcatcagctattgattgatccatcatactttcccctcttacttttttcttttcatcttaaaatctcttagtctattctatcactttaccttggcttattaaacgcgcgcacaactcgtgtgaaaggattgctgatgctggtgaaactgggttttcggcgtgcttttcaagtgctgttaaaaagcttcgcactaatgggtcaaatcccctagttttcaagttagtctgccaatcaggagcctgttgataatgtttaatcccctctttttgaagcgttaaggaacttaagttatccacagtggaaatccctctttgactaaccacttgggccatctcgctattagtttgggtttgcatatcaatcattgctgttcctaacatatctcccttgcgaagattaattcgcgctaaaatcaaattaccgtcctgttggatcagttgaccgtcgacaaattctaccgttcctgaacccattaagaattgcgtggtatcgattacgtgaatcattaaatcataaattgcaaataacggattttgctgctctaattcacgagttttagttacggtaactaaatgcttcgctggtaattgagctaattgttgatgaaaaggcacaaaccggcgattaaatccacaggttaataaaactccttgtttttcagcgagatgatacaattctcgaacttcatctatatcttctgatactggtttatccacaaagacgttgattttattttccaaaaatttcttaataatggcatagtgggtagcagttggtgtgtgcacaaagactgcttctactccctctgttattaattcgtctgaattagttgatccatattggaatccaaattgtttttgaatatgagccaatttctccgcattacgactacttaaatgccattcaaaacgatcttgcaactcactatacaccggtaaataggctttttgagcaatatttcctaatccgatcactccaactttaatcatcttaattagctcctttacccgctcacttttattcgttaaactataggttaaatcaataaaggaaagtgattcaattgaactttatcgcaatggactttgaaacagcagctcctactcgtgcaagcgcctgttcaattgcactgactgttgttcaaaatgatgtcattacagacgaactttactcattaattaaccctgaaactgaatttaattggcgcaatgtccaagttcatggcattcatcaagccgatgtgggtgatgcacccacatttccagaactctggcccgtcgttaaacagttctttacacccgacaaactggttgtggcccacaatgcaacttttgataatagtgtccttaaaaaaactttagaacgttatcaaattaatctactaccatatcaaacactagatactttacggacttccaaaagcttctatccagattacaccaatcataaacttaatacgatttgtgataatcttggaattgatttgcagcaccatcataatgcactggatgatagccgtgcctgtgcgaatatcttattacatcaagaacatcaatttggagccgatgccttagctggttttattcgtccgattaagtaagggataattccatttttataatttgacgcccctgaccatccatggttgggggcgttttagtttgaaaacctaggttttggtaaatttgaatagcatactgattattatccaaaactgctagccaaacttgctctaaccagctaaattgcttcgcccagtataaagcttcatcgactaacattgtcccaatcccgttatgccagtagtcttttaagacaccaacgcctaattcagcccgatgcttcacttcatcagtttcgattagggtcacaatgccaatcggcgtctcccccaacttagcaattaaaagaaaattcaatgggctttgttggatcaaatttagattttcaccaatttgttctagacttaacttagaaattgcatcatcaaattcaatggaagttgtttcagattccaatttttgaattagttgaacaatcccttgtgcatcctcagcttgcccctcaacaaaactaacttcatcggccattgatattttcctcaattgcttcttcgattttttgataatgttcaccgttaggctccaaagttagaaaacgtttagtattgtcatgattgcgatctaaaataacccttaaaaattgatctggcaaatacgatttaatatactgtgaccattccaccacggtcactccatcactttcaaagtattcgtcaattccaatatctcccgcaccgtcttcttcaagacgatatgcatcgatatgaaataatggcatattaccatcatggtactcatgcacaatggtataggtgggactcttcacgtagcgccgaattccaagtgcttgagcaatgccttttgtcagtgtcgtttttccggctcctaaatcaccatctaataagaccacgtcgttagcttccagtaattccccgataattttgccaaatttaatcgtttcggcttcgtcatttagttgataggtttccatgattatttttcctccaaaacttccgttggcaactgccagtcaattggtgtctctcccatcgcttcaagtgcttcgttggtttttgaaaatggctttgaaccaaagaagccccggtatgccgataagggactgggatgggctgattgaataataatattgcgggattggtcaattaacttaatcttgtcgcgggccgcttttccccataaaataaacacaacgggctgctctctttccgataaggcctgaatcgccgtgtcagtcaatcgttcccaaccatgcccttgatgggaataagcttgtccgtcacgaacggtcaacacagaattcaaaagtagcactccttggtctgcccacttttttagataaccgtgttggactggagcaattcccaaatcactttggagttctttgtagatattttgtaacgatggtggaacttgcaccccaggttgcactgaaaaactcagtccgtgcgcttgattttgtccatgatatggatcttgccccaagattaccacctttacttttgaaaaaggagtccattcaaaggcttgaaaaatatggtacatgtcaggatgaatattttgagtagcatattcatgtttcaaaaactcatgcaatttagcataatatgcttgttcgaattcaccttgtaaaacatcttgccaatcgttatggattatttttttcatttcgtaactccttaatacaattttattacttctattctaactgatttagtaaaaaaaaagctatgtcatgttagaattaacataaatatatggattggatgtgcttataaatgatttcaattatcgcttcagatatggatggaacacttcttaacgaagaaatgcagatttcaagtgccaacgcagatgctattaaaaaggcccaagctgctggggttcattttgcagtggccaccggtcgtgaatatcgtgaagccaaacctttgcttgaagcatacggactatcggtcccactaattactttaaacggagccgctgttttcgacgtcgatggtaaagctttagatatggttcccattactaagccatcagccgccttgatcatgcatcaactagaaaaagctggactttactatgaaattacaactaaccaaggcgtcgtttctaatagtcgcactcgtcgaattcaaaccgtagctcatttgcttgaaacagttaacccagacacacctttcaaattagcagtcgctatgtcatcagcacgggtggaactaatgaacattcgctacgtggatgattaccaagttttaattgacgatccgaagattcaagtacttaaacttgtggcttttggtgaaaatggacaaaaggggttgcaacccgttcgcgaagctttacatgctaaagtcgatgttgccatttcatcttcttttgaaaataacatcgaaatcaataatccccgtgcccaaaaaggaattgcggttcaacactttgctgatgaattgaacgttcccatgtcacaagtaatgaccattggtgataatatgaatgatgcttctatgttaaaaatcgctggtgttagttacgccatgggtaatgcgattccggaaattaaaaaacttgctaatcatctgaccgttactaataatgaaaatggggttgctaaagccattcttgagcaacttgatgaaaaccatcagtaaaacgaggctatgctatgcgtagattttatctaaaaagccaaggactcgaaaataagggagctaccattgtcagcgatgaaaagcacaactccaaatatcttttggtcggtaaatggggcattaaaaatgacgctctctcggtttatgatttaaacggaaaattggtttcagaactaaagcaggtatcggttggtaaactgcctaaatttgaactctttttgcaaggtaccaaggtaggaactgttaccactcccatcggttttatccgtggatttcttttagtccacaacttgcattggtggattgccggagatactgtaacctgtcattttaaagttttccacggaatttcaactattctagaaattaatcgggttcaaatcaatggtagtgcctatattgaattgaatgtttttgaccaagaacacctccctctctttatttgcttagcggctattttagatcgctggattcaaaagcgtcctccgctacgcgaacctaaattagttcggacttggaaaatcaattccgacgcaaccagttataacaattttttaaaggagaatttacatgaaaataaccaaagcttccactgcagacattccagcggtgattgaattactcaagattatcttagatgaaatggaactaccattttacttaaataatgatgcagacgaggttaccaaactctttgttgaaacttttaaaagcccgacttatgcagaacatgcagacatcattgttgctaaaaatgaacatgatgaagtagccggcgtggcttatggctatccaggggcccatgaagatattttagatgaggagttccaaaaacactttgatcaagtaaagctaccagctcaaccaatttacgaagatccagaagcggatgctgacgaatggtacctagattcattggtagtcaatcccaagttccagaacatgggaattggaactcaactgcttaatgctctacccgaatatgctcaaaaacgtggtcttaaaaaattaggtttactagttgatgatttaaatcctaacgctgaacgtttatatcgtcgtttaggcttcaaaaatgatcatgaacaagttgtatctcaccataattaccaacatttaaaaaaatcaatctaacaaaaaaagagattatccgctggataatctctttttatctattctttaaggctcgatcgatttcccgttgttgatcacgcttctttaatgattcacgtttatcgtattcgtgtttacctttggcaactccgattaggactttggcaaaaccattttttagatacatcttcaacggtacgatggtgattcccttatttttggtttcttcttgtaacttcaaaatttcttttttatgcaataaaagttttcggttacggaaaggatcatggttaaattggtttccttgtaaatattcattaatttgaacgttcatgaggatggcctctccgtgccggatctgtacgtatccatctctcaacgttactcgccgatctctgatggatttaatttccgtccccgttaaaaccattcccgcttccatcgtacttaatatggaataatcatgacgcgcctttttattttgggcaagtgctttatcattggactttggtttcttagccataacataacctcctcttatttcttatgagaagtatttttagaaaacttcttgaccgttttatctttgtaaaatggttttccgtttcgatttcctgatttattgttgttctttccgctaggcttttgaccgttacgacgcggaccacggttaaattgttgacgcggtggaagttgaatatcactcttaggtgttttttctggatgcaataattcaaaatcaacttcagattgatccttatccactcgcattaatttaatctcaacttcttgaccaatttggaatgtacggtgggtattccgtccgaccaaggccatctgtttttcaacatattcatagtagtcatccttcatggtactaatatgaattagtccttcaaccgtattttccagttcaacgaataaaccaaacttcattactgaactaactaccgcatggaattcttctcccacatggtcagccataaattcagccttcttcattccatcaacatcacgttctgtgtcgattgctcgacgttctaacttggaagtatgatcggcaatttctggaatgctttcaacatatttcgcttgtgctgcttcaccagtaccattttcggcataatgacgaattaagcggtgcacaaataagtccggataacggcgaattggtgaagtgaaatgcgtataatactcagcagccaatccaaaatgacctaatgattgagcatcatacttagcttggcgcatactacgaagcatcattactgaaatcattgcttcttctggagtcccagcaatcttcttaagcacgctttgcagcatcttaggcttcagatccttggtgcttcctttaactacgtgtccaaatacagataggaattcaaagaaggttaacattctttcgctatcgggagtttcatgaatacgatataagaatggcacatgagccttatagtagtgctcagcaaccgtttcattagctgccaacatgaatgattcaatcatacgttctgaagtcccacgcgtccgtaatttaatgtcaattggatgtccggtttcatcaacgatgatttgggcttctttatcgctaaattcaattgctccacgttgcttacgcttcttaagcaagattttgtgaagttcgcccatcatttcaaacataggcactaattttgcataacgtgccatagttttttcgtctttagattccaaaatcttattaacatcgttatatgtcattcgagcatctgattcaattacacttgggtaaatcttatggttaactacgtctccttcaggcgtaatttccatttcacaagtcatcgaaagccgttcaacattagggtttaatgaacaaattccgttagaaagcttacgtggcaacattggaattactcggtcagtcaagtaaacacttgtacttcgacgatatgcttctttatctaaaggagaaccttctttaacatagtgagaaacatccgcaatgttaactaataaacggtaatttccattatctagttttttaagacctacagcatcatcaaaatctttggaatcatccccatcgattgtgaccactacttcattagttaaatcaacgcgtccttttttctctgcatctgttacatagtctggaatcgaagcaatctctgctttgacatcatctggaaattcagttggtaactcatgttgataaaccacttctaagatgtccactcctggatcatccttatgaccaaccgtcttttcagcaaccccggcaattaacttaggagaattaggcttaggatattgcgtaacttgggccgtgatcactgaaccgtcagttggttgaattccgccttctagaacatcaaattgatatgaagacattttcttgtctttcaaattgatatgacctaaaacattcttctctggttcaggagcaaattcaaaaacccccaccgcttgggtaaagtggcgacttgtaattttcttaacaattccttctggaccacgatcatcacccttcttagatggacgagtaatttttacatcaacttcatccatatttaaagcatacgctgtatgatcttcactaatataaatgtcaggaatttcatcctcttctactgaaacaaatccgaaaccacgatcattagcatggaacacaccatgaactaataattgatttttaggacgagcaattttaaatttgccatcttccgttatttcaacttttttagaacgttccattaatgccaattccttgactaaggtgttaaacacgctggccccttctaaatttaaacccttaaaaagttcctcagcagttaacttttgggttggtcgttgttgcagataattaataattaaagcttgtaatttgtttatttccatttcttacctcatatttttgtatttattaaataaaaaagctaaagacaaaactaatttcgtctttagccgttcctaatgattccgaaatctaaatttcagaatttgctaaatgcaatttttttgttcaatacgatctctctagtgtgcagatacgtaaaccattgcaatggtgacagcaaaaaacaagaaaagcaagactgcagttactttttgcataaatgcttcaaatccacgtggtttttgctttgcaaataggtcaccagcaccacccgttaatgaagacatcgcgctgtcagtcttagccggttgcatcataaccgcaatgattataaacactgacagaatcaatagaattgtcatcagaagtgaatacacaagatgacctccttcatgttcttaataagttctagtactaatttaacatatttgagcctgaattccaatttaataacaaaaaaagaggcggacaaaatgtccgcctctttgattgacctaatttaattacttgttgctgatttcttcgcgagcgtcagcacttaggttgtagaatgagttaatacccttgtattctgcaacgccttcaagttggtcttcaatacgcattaattggttgtacttagcaatacggtctgtacgactcattgaaccagtcttaatttgacctgcatttgtagcaacaactaagtcagcgattgttgtgtcttctgtttcacctgaacggtgagaaacgatagctgtgtaaccagcttctttagccatttcgatagattccattgtttctgtaagagtaccgatttggttaaccttgataaggattgcgttagcagcacccatcttgatacctttagcaaggtattctgtgtttgtaacgaagaagtcgtcaccaacaagttgaactttcttgccaagttctttagtgatgcttgcccagtcgtcccagttgttttcatcgataggatcttcgatagaaatgattgggtatttgtttactaagccttcaaggtacttaacgaattcttcagtagtgaattcttcaccagttgaccagcgaagcttgtacttcttgtcttcgtcgttccaaagttctgaagcagcaacgtcaactgcaatagcaacgtccttacctggtttgtaaccagccttttcaatagccttgattaggtattgaagaggttcttcattgttagcaaagtcaggagcaaatccaccttcatcaccaactgaagtagctttgccatcagctgacaaaagactcttcaaagcatggaaagtttctgaacccatacggatagcttctttaacagaaggagcaccaacaggcatgatcatgaattcttggaagtccactttgttttctgagtgagctccaccattgataacgttcatcattggtgttggaagaacatgagcgtttgaaccgccaatgtagttgtatagaggaacttgtagttcatctgcagctgcacgagcaacagcaagtgatacacctaagatagcgttagcaccaagcttacccttgttaggagtaccgtctaatttgatcattgccttatcgatagcgatttggtctgtaacttcaaaaccaacgatttctttagcaataggaccattaacgttagcaacagccttttctacaccttttcctgagaaacggttcttgtcgccatcacgaagttcaacagcttcgtgttcaccagttgaagcaccagaaggaacgattccgcgaccgaaaccaccatcttcagtataaacttcaacttcaacagttgggttaccacgtgagtctaggacttcgcgtgcgtaaatatcagtaataagtgacattttaaatatctcctcacatttttaaatctgcttaacgcagttcaactattattatattatatttccttaattatattaacccttgtagttaactaattctaggaatgattctggatcaagtgatgctccaccaacaagtccaccatcaatatcttctttgcccattaattcagcaatgttagcaggttttacactaccaccgtattgaatacgtactttgtcagcaacagtttgatcgtaaagcttagcaactgtttcacgaattacgtgacaaacttcttgagcttgatcacttgaagctgtcttaccagtaccgatagcccagattggttcgtaagcgatcactgatgcagcaacttgttctgcagttaaatctttaagagcgtttgtgatttgaccagcaacccattcgttagtttcgccagcttcacgttgttcaagagtttctccacagcaaatgattggtgtcatgttgttgttgaagattgccttagccttcttgttaatatcttcgtcagtttcaccgaagtattgacgacgttctgaatgaccgataacaacgtagttaacgcccatttcgtttaaagccttaggacttgtttcgccagtgaaagcaccttcgtcttcgaagtagctgttttcagcagcagtctttaattgttcatcttttgagaaagctactaaagtgcttaaatcgatagcaggagcagcaataactgattctactacagaagcatcaggtaacttacctttgatagcatccaagaattcttgagtttcttgggggtttttgttcattttccagtttccagcaataattggagtacgcaaaataaaacatcctttccgaattacaggttatgtagcagaaaagaagaatcaactgattcttcgatttctacaactttaattatttgtttgaaatagcagcgataccaggaagttctttaccttcaaggtattcaagtgaagctccaccaccagttgagatatgtgtcaattggtcgccaacgcctaattgcttaacagcagcagttgagtcaccaccaccaacaattgttgtagcgtctgataatgtacctaagaacttaccaacttcaagtgtaccgttagcatagttgctcatttcgaatacacccattggtccgttccatacaacagtcttagcatctttaaggacatccttaaattctgcaactgacttaggtccaatatcaagagccatgtaaccatcagggatatcgccttcgacaactttgttaggaacatcgttatcaaatttttcagcaacgatactgtctgaaggaaggacaatcttgtcgccacccttagcaaggatttctttagcaacatcaatcttgtcagcttcaacaagtgagttaccaatgctcatgcctttagcagcgtagaatgtgtatgtcataccaccaccaataataactttgtcagctttattaagtaagtgatcgattacaccaatcttgtcagaaacctttgcgccacctaaaatagcaacaaatggatgcttaggttcgtcaacagcttcacccaagaacttgatttctttttccataaggaaaccagcagcaacttgcttgccgtcagccttcattgcttcagcaacaccaacgtttgaagcgtgggcacggtgagctgtaccgaaagcatcgtttacgaacatgtcgccaagtgatgcccagtatttgccaagttcaggatcgtttttactttccttcttgccatctaagtcttcaaaacgtgtgttttcgaacaataatacatcgccgtcgttcatgccattaacagcatcttcaagttgtgcaccgcgtgttacaggaacaaatgtaactggtttgccaagaagatctgaaaggcgttgagcaactggacgaagagtcaattcttttttgtcttcttcagtcttgatacgacctaagtgagagaaaagaattgcctttccaccgttttcgataatgtatttaattgttggaagagcagcaacgacacggttgtcatcaccaatcacaccatttttaactggcacgttaaagtcaacgcgcatcaaaactttcttgttcttaacatctaaatctgaaacagttaatttagccaagagaatttcctcctaaatcattaataaattattttttctaaaaaaagggacggaggaagtgacctccctccgtccctagaccgattagacggtttgaaatctacaatttttaagaattaatcttaaagagtagcaaatttcaataaagtacgtaccatttggcaagtgaagccgtattcgttgtcgtaccaagcaacagtcttaactaattgcttgtcgccagctttagtaacttctgtttgtgttgggtcaaagattgagccgtatgttgtgccaatgatgtcacttgatacaacttcgtcttcgttccaaccgaatgattcgttaccttctgtatgcttcttaatagcagcattaacttcttcaactgtaacgtccttgtcaaggattgaaacaagttctgtcaatgaaccgtcaacaacgctaacacgttgtgcatgtccttgtaacttaccgttcaattctgggataacaagaccgatagccttagcagcaccagttgagtgaggaattgtgtttgcagcagcagcgcgtgcagcacggaagtttccaccacgaacaggtccgtcaagaagcatttgtgtacttgtgtaagcatgaactgttgtcattgtaccaatttgtacgccgaattcttcgtttaagaagtaagccattggtgcaagacagttagttgtacatgaaccagctgaaacgatacggtcgtcagcagttaaaacatcatcgtttacgttgtaaacaacagtcttaagatctgagccagcaggtgctgaaaccaatacacgttttgcaccagcatctaaatgagcttgtgatttttcttttgatgtgtagaaacctgtacattcaagtacgaagtcaacaccgtcttccttaacccaaggaatatcttgagcctttggttcagcgtatacacggtattctttgccgtcaacgataattgagttatcagttgcactaacttcaccagcaaaagttccatgtgttgaatcatatttaagcaagtgtgctaataaagcaggacttgtcaaatcgttgatagcaacaacttcgatgtcatttgattttgcacccaattcgtggatacgacggaatgctaaacgaccaatacggccaaaaccattaataccaatctttacagtcataagtaagatttcctcctttaggaatctaaaaaaataatttattttaaaaagttaagtcacaatggctttacttttttaaaatcgcgtttgctgcaccttcatcagtaattaaaattgtctgatgcggtgcgattttcatgtacgactcaatagcctgagccttgtcatgaccactagccacggcgaatacatgattgaaatgctgaacatcattcagctgtaacccaattcgatgaacttgatataggatgcgtccttctcgattgtagaaagatccaaacgcttcccccacagccttggcttttcgaaggtaacttaggatttcttcgttaactcctcgacgtctggccatatcgccagctttaccaataccatgtatagcaactcctgcgtgactaattaaatccaacacaggttttacagtcggttcatttaaaagggggtggtaagtgctctcactcaattgttccggaatgtataatgacttggcttcacctctagtgcgcttagccatcaacgccgcaactgaattagcttgtttatcaactgattcaccaattccaccacgacccggtacaaaggttagctttcgattgttcgaaagctctggagacaactgcatagcaaccgatgccatggttgaaccgcccattaccactatagtattattaccctctggcaacaattttgcaagtgcatcatttaaaattgttccgagttgttttgtgaccgcatctccgtcagcacgatctccccgaacgataaaacatctttcgatgtccaaacgttccgccaatagcttttcttggctagttaagcctaagaatcggttagctacaggttcgagaccattcataacgcgccggccctcatcagaaagcatcattccagcctgcgaactcgtcaacaatccttgtgtttttaacacatcagtttgtgatcttagcacgcgttcgctgagatgtagatgttccgataaaactcttctcccaaccggagcaagcagatcgattgattttaagatatcaaatctctgtagaaattcaccaatcaaacctggaacaacagattctaataaatccatctcattatcatccatgttatctcctgttgtgggacttgttttgtccagcagtgccacaaaacgacccaacaaattaaaaataaatggcacacaaactcaagaattaacttttgttgtatacctcacttacgaattaaattataacaagcccccatcttttttgcaaatttaaactcaacttatttggggctttttaaattaatcaaatcgcttgcgttttgaagaagatggaatcccaatggcttcgcggtatttggcgacggttctccgcgaaatcgcaatcccactttcttttaaatttttctcaattttcgaatcagaaataggttttcttttatcctcttcatcgataatttttttaatcttttcttttgctgcatctgctgaaacatcactttcacgattaacagcattactaaagaacgatttcagttcaaacgtaccaaatggggttgcaatatatttaccgttaacagcacgagatattgttgattcatgtaaatgtaatttattcgcgacatctcttagaagcaacggttttagctctttactttgattcataaagaattcactttgcttttcaaagataatctttccaactctgagaatggtatcttcccgttgacttaaactcttcgaaatccagtcgtattctttcttcttctccgtgacataagctttgacctcttcatcaacgttttgaagttgttcaaaataatgttgtgagaagctgactttaggacgtgaagccttagactgtagtaattgaggttcatcattttcaatgctaaagattaaatctgggataatgtaactatgctcttgttttccaaatcctgctccggggttaggtgttaatgttctgacgtaatcaaaaaccgcttggacatcactcaattgaatatcatattttttagcgattttatcccattgacgattgactaaatcttcaaaagattcttccaaaatcaaataagcttgttctggagaaaatgtatcattttcagtttgtagcattagacactcttggagcgagcgagcccccactccaggtggatccaactgttggagtaaagtaaccgcatcgatcacagcaatttcatctgcaccggtcttttcaatcactgcttcattggatattcctaaatacccattatcgtcaacatagtctaaaagcaacaatactaggcgtcttaatggtgtatctcgcatagttaaatgaacctggtctaataagtagtcaaatagcgattgttccgtatcactagcaatttgattcataaatgcctcgtgtcgatcggaatcacctgaaatcttactagttggcttttcagcagccatttcaaccgtaataagtggattatccatttctttttgtttgagaaaattttgaagctcttcaacgttatattgcagcatctgaatcgactgttgtagggtctgcgtcatcgctaaacgttggatttgcttttgttgttgagtttgattttgactaaatccttgttttattgccatagtaattctccgcaattatcttgttttttcttctgtcctactgtaaaatcaaattgttaggcgccgttagtgtaatggatagcacgtgagattccggttctcaagctgagggttcgactccctcatggcgcattacttagcgaatttatgcataaattcgcttacaactgcattatatactactatttattcaatagctacaaccattgtctcctggtacattagacaatatatgcaatctggtcgaaaattttctccggctaggttgttttttattttaaagagcaaaaacatttgaccttttttgaccaatgatataaactatagccatgttagttatttaacaggaaattttttacgataataaaggaggttactaagttatgaacttggtcccaacagttattgaacaatcatcacgtggtgaacgtgcttatgatatttactcacgactattaaaagatcgaatcatcatgctatcaggtcctattgacgatgatttagcaaactcaatcatctctcaactactcttccttgatgcacaagactcagaaaaggatatttacctatacatcaactctcctggtggagttgttaccgccggtttagctatttacgataccatgaacttcattaaatctgatgttcaaacaatcgtaatgggaatggctgcttcaatggccagtgtacttgcttcatctggtacaaagggtaaacgttttgctctacctcattcagaagttatgatccatcaaccttctggtggagctcaaggtcaacaaactgaaattgagattgctgcagaacaaatcttgaagactcgtaaagaattgaatacgattttagctgaaaattctggacaacctcttgaaaagattaatattgatactgaacgtgataactatctatcagctcaagacgccgttgaatacggtttgattgatggtatcatggaaaaaaatgctaacttaaaataattagtggcataaaaaagacatcggaaaaaattccgatgtcttttttattttcctagtgcacttttcatcattttgtaacgaaattcgaaaatttcttcggcaatttgtgcttcgccttcaatttcctcttcgagggctgagaaattcttttcaatgtcagcatgcggatagatgtatttttcaggatcttcctcatttttacttgctaaccaatcccaataattatcttcaataagataaccacttggcaaaactttagtaatagtccccaatcttccatcccaaagttgtacaaattgaaactctgaatatttcatcttccattcatcctttccccatataataaaaagactgtaacacagattgcatgttccagtctcctattttaacctaattaaatcttaaagatgaagggctttgcttaatccgtctaatttaaagaaaccattactattgatgcagttaattatactaccaacataagtggttgaagttgcgtaaccaccagccttgatagctttaatagaagccacatagttagctgattttggtgcaaatgcattagcgtattgtgcacgtgattcaagtttcttagcgtaatctgcaatcgaatccttgatagaagcatattttctaaatgaggcattgatagtaactgtgcgaccattgataacttctttagtactcttagtataggtagcgcctttccaagtgctatcggccttaatcccaaataaattgtgcgcttcttgagcaagtgatgaagttccatacccgctttccaaaactgcttgagccatagctacggaagcatagagcttattactattacatacgttaacaatatctgctgcaataccatttacaaaattagtttgtgcagttgtccaatgtttgctagttaaatgaacattcacattatgcatggaagccgcgttattcttgtttgatgaacctgaattggattttgagccagctaatgttacatccgccttattaatccaactaataactttgtctaaaagcaatttactaccgttaacctggataactttgtaagtcttgcccttaactgggttgtaaatagattgacccgttgcccaatgcttagcattcttattgatggttactttggaacctacaccaatcttattgctgctgttatttttattactattactactgttacctttgttagaactggattgatttgatgatgaagaccctggcaccgtaacgtcacccttgttaatccaactgataaccttgtccaagagcaatttgttaccattaatttgcataaccttgtaagtcttgcccttaacggcactatagattgtttgtccagttgcccaatgcttagcacttgtcttgatggttactttatcgccaacatttatcttgcttgaattatttttattactatttgaatcatttttattactgttgttagcattatttttgttgctatcattagatgtattattacttgaatcactactgctactaccaaatccatattgaagatcatgggcaaattgagtttgtgaaataccatgggtcgaaagatatccataagggtctacatggtttccccaaacatgattagtaatccatacatgagatttaatgccacgatattcactactgtctagactggttggaatattccatttcttagcagaatcccttagtaggttaacgtaagtttgataatcttttttaaattggctatcagaatatgtttgtgctaactcaacttgaacaggagcattttcattagcccattcgcctgcgccccaagcgacgtatccttcttgtccaactgcataaactttcccaccatcaccaacgatatattgtacatagctttcgctactgtcccattcacgtttttcaaaaatagctacattttcagctggtgcataaactccagtggcgtgtgcaatgattacgttatttttagtttgctgatcactaccctcgtcgtcacttaattgatgcgtataatcaatcgtatagtcctttgaagttgatttcttatctaccgctttatttttagaagtagtagcagcactacttgttttagagaccgcacttgaacttacactagcagctgagctcgttttaatagcagctttggagctggctgtcgaagaagcggcacttgaatttgaatgcgcaactactgaaacagctgcacttgagtttttagtagaactagaacttgtatttttaactacacttgagctattagcaacgctcttagcagtgcttgaaacggttttttcactagcagatgaagccgctgaactagcaactgatttctttgcactagagcttgcagttgatgtagcagatgaacttatcgcgctcttagcagaactcgaagtcaccaccgaattagttgcagatttacttacagcgctggaagtagcagtacttgtaactgctgaagttgctgagctagccacactagcactagctgctgaactagctggtaaagaagtcttcgttaatgtaacacttgcttcgcttacgggtgaagtagtcgtactatcatcaaccgtatcagtagcatcattgtcggtgctatcggcatgaacattagttgcattagcatctaaagcaatgatccctaaactggcagctgcgatacttgcaaaggcccactttttacccgctttaaacattttgtaatgtaatttagaattcataaactcatattcccctttagtttgtttacctagttgacattcatctatcgtaatcaatattagcataataatttgttccaattttttacattacaattacattaagcccttacaatatacactgtgtaaaaaagaggacaccttcaagtaattctgaagatatcctcttgatttaattaagctcttagcttctcagcgtattgattaatttttctcaggcgatggttaatacccgatttagatattggaccaccgggtactaattcacccaattctttgagactaacttctcgatgaatcaaacgagcctcagcaacttcacgcaatttaggtggtaattcacctaatccgactgtttcatcaataaattggatattgttaatctgtttcatcgatgcattagcaactttatttaaattagccgtctcacagttgactaaacggttaaccgaattccgcatatcacgcataattcgaacatcttcaaatttgagcatcgaattagttgccccgattaattgtagaaagtcggcaatatgttctgcttccttcaaataaacaatatatccgctacgtcgctcggtcgttctagcattcaaattatacttattaatccaatcagcaatcatttggttatgtgattcataaagggaataaatttccaaatgataacggctagtttctggattatttactgatccgctagccagaaaggctcctcgtagataggaccgtaattcagattcttcggtcaacaaaccttccgggactttttcgttaatctgaaaatcatcttttaaaatcgataaatcattcaataactccttaacgcccgttcgtaaacgaacgatatacaagttattcttcttcaatttcatcttccgtcgaacactaagttctgcttccaaatgataaaattctttaagtaaagaataaattcttctagcaatggctggattttcagtttgtgtatttaatgtaagctgacgattattgataccaattgcaccgttcattcggattaacgccatcaattccgccttagcatttttttcgtgaacttccaaacttgtcagttctttttttacttcacttgcgtatgacaaattctgaacctcctaatcacgcttcttgatggggttgctacaaacattcatcaattcgtctacaactttctgcccatcatggaacgctccaccatctctcaacaataagaaattgtccgatattactcgtgcaccctgttcccgtaatcccttaaaatcatgaactacttgtttggaaacttcatcatagcggttgaaatccatgtaggattctggcacgatttcggtattaacgagtacggtatcgacaaagttttgtcctaagtgtcgattcaatgttcgtacatgttccgcatctgtaaaattaatagtttcacccttttgagtcataatattacagatataaacaatttcagctttcgctttaagtacagcacgtccaatatcttcaatcattaagttgggcaagatactggtaaatagactaccgggccctaaaataatttcatcggcttcttcaatcgcctgcagtgcttccggtacagcatggggtttcttagtttcgctccatggattgttacccacccacacttctttaatgtctttatgagccgctgtgatttcagcttctcctgctaacagcgtgccatccgtaaatttagcatgtaacactaaaggttgtgcactggcaggataaacatggccttcaacttgaagcatttctgataattctcgaatggctggatcaatcccaccacgcatttcggaaagcgccgcaataatcaaattgccaatagcatgtccggcaagaaacttatcttgacttctaaagcgatattgaaaaatatctttaaattcaggggcaatgtcagataaagcgaccattacatttcgaatatcccctggcggaactacgttaacataatctcggatgatacccgatgaaccaccgtcatctgcgaccgttacaatcgcagtaatttcagcattgcgttggtgtaattctttaaggataactggtagtcccgtgccgccaccaattacgacaattttaggacctttttttctggtcatgatcgatttaccgtttcctttcgtttatgcgcatctcgatgcgatatatttgtgacatattttttagataaatcttttgccaaacgttctgcaatagcaactgaacgatgttgaccaccagtacagccaattgcaatcgttaagttggatttaccttccttttgataccctggcataatatccatcaataattttaagtaatccgtataaaattcttcggtagccggttgattcatgacatagtcataaactgctggatccgttccaattttattttttaattcagtaacatagtatggattaggtaaaaagcggacatccataatgatatcggcatcaattggactaccatatttatagccaaatgaaacaacttcaatgtggaacttaggaatcgtcttattcgttgagaaatgtccaaaaatatcacttcgtaactcacgaggtgtcatattagttgtatcaataacaatttgtgcttctgatttaatcggtgataaaagctcgcgttctttacgaacgccatcagctacccgtccatccattgctaacggatgagcgcgacgagtttccttatagcgagcaaccaattcttcatccgtcgcatctaagaatacaacgtccgttttaatattatgttgttcttcttcaccagtaagtaatcctaagatttgatcataaaaacctcgtgatcttaaatctacgactaacgctactttgctaatttttccattttctttaattaattcccaaaactttggtaataaagcaggtggcatattatccacacagaaaaatcctaaatcttcaaagctttgcattgcgactgttttaccagccccgctcattcctgttaccacaacaaattgtagtcgttcattcattattaattcctcctataaaggtagctactccagtataacacatccgggcgtgtcttttttaagttatataaaaaggagcacaaattgccccttttgtattatttctgactaagttcttgagcacgctccagaacttctttcaaatatttaccagtatagctttcaggtaccgcagcaatggcttctggtgtaccaacagccaccacttgtccaccaccagcgcccccttcaggacccagatcaatcaaatgatcggcagttttaattacatctaaattatgttcgattactaaaacagtattaccattatctaccaaacgttgtaatacatctaacaaacgtctgatgtcgtctgtatgcaaaccagtagttggttcatctaggatatagaagttcttaccattcgcttttttgtgtagttcggaagctaacttcatacgttgcgcttcaccaccagatagggtagtagctgattgccctaaatgtacgtagcccaatcctacatcaataatggtttgaagtttacgagcaatcttagggatgggagcaaagaaatctgttgcttcttccaccgtcatatccaagatatcagcaattgtcttgcctttgtacttaacttcaagtgtttctgagttataacgtgttccatgacagacctcacaaggaacgtaaacatctggcaagaaattcatctcaatttttagaattccgtcacccttacatgcttcacagcgtccacccttgacgttaaaactaaaacgccccttcgtatatcctcggagtttagcttcattagtctgagcaaataagcctcttatatcatcgaaaacgctcgtataagttgccggattacttcgtggggtccggccaattggagattggtcaatattgataactttttcaatatttttaataccactaaccgatttatatttacctggtttttcagaattatggtttaatttttgagccaaaactcgttttaaaaccatattgactaacgtagatttacctgagccagaaactcccgttacagcgacaaattcacctaatgggaagtcaacatcaatatttttaaggttattttcttgaaccccttttaatttaatagattgaccattacctgtacgcctagtttctggaactggaataaatttctttccggataggtacttacccgtcagtgatttacgacttttagctacttgcttaggagtaccagctgccatgacttcaccgccattttcaccagctcctggtccaatatcaataagataatcagcagcccacatcgtatcttcatcatgttcaacaactactagcgtgttacccaaatcccgcatctttttaagggaactaattaatcgattgttatccctttgatgtaaaccaattgaaggttcatccaaaatatatagcacaccagataaattcgagccaatttgagttgccaaacgaatgcgttgggcttctccacctgaaagtgttcgagccgagcgacttaaagttagatactctaatcccacgttacgtaagaaattcaaacggtccttgatttcttttaagattggagtggcaacagctgtatcctgctccgaaaagtttaaattaccgaaaaattccatggcactatcgatgggtaaagctgaaatttcggcaatatgttttccatcaatttttactgataaagcctttcgattcaaacggtaaccatgacaagtttggcacgttaattcgcgcatgtataaccgcatttgatctcgcgtgaaatcactattagtttcatgatagcgacgatcaatgttaaccattacaccttcaaatacggaatccacatcccgaactccaccaaaatcattttcatagtggaaatggaatttcttacctttagaaccatataaaacgagctggcgatctgctttaggtaaatcctcaaaaggagtgtccatatcaattccaaaacttttagcagcttgttctagtaaggttggataatattgcgaactaatcggattccaaggtgcaattgctccttcacgtaacgtcttagatggatccggaatgactaaatcttcatccacttccaatttaattcctaatccatcacattcaggacatgctccaaaaggggcattaaatgaaaatagtcggggttcaagttctcccactgtgaacccacaaaccggacaggaataatgttctgagaacaagattggttcgccaccaatcacatctgctgtagcataacccttactgaggcgtaaagctgcttcaaatgaatcaaataaacgagaccgaattccgtctttaaccaccacacggtcgaccacaatatcaatggtgtgaactttgttcttatccaattctggtacttcttcaacatccatggtttcgtcatctactcgtacccgcacaaagccttcacgtttgattttttcaaaaacctttttatgttggccttttttagcacgaacaatcggtgagatgatttgcaccttggaacgttccggcaaatccaaaactcgattcaccatctgttcaaccgtctgactggtaatcggtgtaccatcattgggacagattggttgaccaactcgcgcccataatagtcttaaataatcattaatttcggttacggtcccgactgttgaacgaggatttttagaagttgtcttttgatcaatcgaaatagccggactaagtccatcaattgaatcaacatctggcttatccatttgccctaaaaattgacgagcatacgctgacaaactttctacgtagcgtcgttgaccttcagcatagagggtatcaaaagccaatgaactctttcctgatccagataaccctgtcaccaccactagtttatcgcgtggaatggtaacatcaatattctttaaattatgtgctcgtgcaccgtggataacaattttatcatttgccaaaaaagaggcctcctaaccaatctgtgcttttaattctaaaacggtatctcgcaagttagctgctttttcgaagtctagcttcttagcagccgctcgcatttgatcttccaagtttgcaatcatttctttttgatccttactatccatgtcggcaaaatcaacgtccaagaagtcgtcttttttacctttatcctcagtatcactggttgatgaaatcaacgaacgaatatcctttttaattgtatgaggagtaattccatgttcacggttatatgcttcttgaatcgtacgacgtcgtgcagtttcatcaatggtttcttgcatggacttagtcatatgatcagcatacataataacgtgtccattttcattacgtgccgcacgcccagccacctgaatcatcgaacgagtatttcgaaggaaaccttccttgtcggcatctaaaattgctactaaagatacttccggaacatcaattccttcacgaagcaaattgattcctactaaaacatcatacttgcctacccgtaaatcacggataatacgggttctttccagcgtcttaatatcactatgcaagtaagcaaccttaatccccatatctttcagataatcggttaaatcttcggccatcttcttcgtcaaagttgttacaaatacacgctcgtctttttcaatccgttgattaatttcacctagcaaatcatccatttggcccatgattgggcgtacttcgatgattggatccaataacccagttggtcgaataatctgttgaacaacgttattagttcgttcattttcataatcacctggggtagctgacatataaaccacttggttaatatgtttttcaaattcttctaatttaagggggcggttatccaacgcacttggcaatctaaacccgtaatctactaattgttgcttacgagctcgatccccattgtacataccgcgtacttgtggcatagttacgtgggattcatctacgaccaatagaaaatcatcagggaagaaatctagtaaagtataaggtgcttcacctggtttacgaccatccatatgtctggaataattttcaatcccgttggtgtatcccatttcttttaacatctcgatatcataggtcgttctttgtcgtaaacgttgcgcttctaggagttttccctcaccatctaattcttccaaacggtccttcaattccgcttcaatgttcttaatcgcatgttccattcgatcttcgttagtcataaaatgggttgctgggaaaattgtaatatgatctcgatcaccaataatttctcccgttaaggcatccatttcacgcattcgatcaatttcatccccaaagaattctactcgaatggaatgcgcatcattagcagccggaaaaatttcaactacatcgccatgcacccgaaaacggccacgctggaaatcaatatcattacggtcgtactgaatatcaactaattctcgtagtaacttatttcgatcaatctcctgccctactcgaagtgttaaggcttgatcttggtattctcgaggatcacccaaaccaaagatacttgaaacagaagccaccacaatcacatcattgcgttcaagtagtgaactagtagcggagtgacggagctcatcgatttcatcattgattgatgagtctttttcaatataagtgtcactagatggtacgtatgcttcaggctgataataatcataataactaacaaaatattctaccgcgttattcgggaaaaactgtttaaactcgccatataattggcccgccaaagttttattgtgtgacaaaattaaagttggtttattcactttttgaattacgttagaaatcgtaaaagttttcccggtacccgttgcacccaacagaatttgttctttttcgccacttttaataccgtcaactaattcgttgatcgccgttggctgatcccccgttggttggtacttagaaaccaattcaaattcacgatcattctcacgtttaatcattcgttttcctccgttcacacaaaatgactgagattgaaccgatcaggatcagttctcagccatttcctaaaattatatttactcgaaattaaccataactattttatcacaccgaacatactttcgccatttttaactacgcgataattgcacgactaatgcgttccaatttaagttgatccgtaaactcttcattcaaaaggtctggtaagacattatctaagaaatactccacgctggccatcgttttgaattcaacaatcgtccgtaaactttccttataaatttccgtataaacatcttccggatttcccttttgaatttcaccaaatgattcatataataaatcaattttatcagccacagaaagtatttgtccctctaatgtgtcatccttaccttctgagagccgacgcgtgtaagctccttgaaattctactggtatttcatttttaatgaaattgtctttcatggaatcttccacgttagctaacatcgttcgtaaatccggtgttgcatacttaacgggggttttaatatctccaataaaacgttcgttataatcatgatttaatgatttttcataaagtgagcgccaattaacttcattgccagcattttcttcaatatcacctaaaaattgggcaatttcagcaactttaaacgaatgctctgcaaccgagtgtttttgatatttaaaaaatcctggtgcccgataaattgtttctaaattacttaaactcttcaaatattgatgcattcccatggcaatctctccttaaacttacttaaattgttactaatattatcacaaaaccatttccgattcacttaattagaataaaaaagaactatgctccaaaagcccaactgaatcgcgcataatcattcaatttgagctccgtcatagttctttaaatattattttataagttcattaatagctgtttcaaaaacatcaatcttattcaaagcatctttttcatcttcgccaactgtaccaatatagaatttaatttttggttctgttccagaaggacgaattgcaatccaagtaccatcatctaatgtaaatttcaaaacatccgcttttggtaatttgatagcttgggtagatccatctgcttcatacttagtttgagctaagaagtcttcagtttctaataccttgtactgatcaaattgacttgggcgttcttcacgaaccttttccataatggcaaccattttttctttaccgtcaactccagggaaatcttttgaaatggtcttttcttcatgatatccgtaagtagtaaataagttttgaagaccgtcatataaggtttgccccttactacgataataagcagcaatttcagccaataggacaattccttggatggcatctttatcgcgaacaaatggccgaacaagatagccataactttcttcgaaaccaaacataaaggtatggtcgccattttcttcgtaatgtttaatttggtcagcaatgtacttaaacccagttagaacgttaatcatttctacatgatgggcttcggcaattctggttgctagttcactagaaacaattgacttaacggcagctgcgttacctggcaagtcacctgctgcatcatgcgcagttaagatgtattctaacatcaaggctgcaatttggttccctgtcaataatttgtagtcaccatttggtaaacgaacggcagctcccaaacgatcggcatccggatcagtggcaatcaaaaggtcagcatcttgctttttacctaattcaatagccaaatcaaaagtttgtgggaattctgggttagggaatggcgttgtaataaattctgggtcagcaattgcttgttcagggaccatagtgtaatccttaaaaccagcattttctaacgcacgtccaccaactacttttccagtaccatgtaatggtgagtagatcaacttcatgtctgcaccaaagcgttggattagttcatgattaattgataccgtcttaacttcctcaagatacttgaggtcaatgtcttcaccaataatggtcattaagcccttagctcttaattcactttgagtaagtgcttcaacaccaaagatgtcagttacttggcggatatattctgtaatcttatcagattccattggtggcatttgtccgccatcagaaccataaatcttatatccattatattgtttaggattatgactagcagtaatcatgattccagcataagtgtttaactcacgtactgtatatgataattctggagtgggacgcatactatcaaaaacaaaacttggaataccatgcttacctaaaacaccagctgctgctaaagcaaactcttgtgagtgatagcgggaatcaaaactgatcgccactccccgtttcttatcagtaaaatccaaggtatccataaaattagctaaaccttctgttgcttgacgaaccgtatagatattcatccggttgataccagggcccattacgccacgcattcctgctgtaccaaattccattggagcataaaaggcttcttttaaagcatctttatcttcagctaaagttgctaattctttttttaaattaaaatctaaatctgcataatcttgccattctttgacagaatcttcccaactcattcaaaaatcctcctatgatgtaacttatagttactttcattatacaatacccatggaataccagaaagcgtttttttaattttaggtatagaccaatcactttttgaattttggcaaaaagaaaagccccggttttcaccgtggcttattttgactttaatcatttaaagcttgaatatattcatacgcttgttgtccagcgacgccaccgtcacctacggccgttgtgatttgacgtaaatctttcttacgtacatcaccaacagctagaattccaggaaccttagtatgcatatggtcatcagttggaatccaaccttgttcatccaaaatacctaagtccgcaaaggcggccgtcatgggttttacccctacgtaaatgaatattccggctgcttcaataaatgaatcttcgccagtttggttattattaactttaacgcccgtgaccttaccttcaccaactacttctgtaacattactgttccagacaaattccatcttaggattggcaaaagcacgatcttggataattttttgagcccgtagttggtcacgacgatgaatcacggtaaccttagaagctaattgtgttaggtataaaccttcttcaatagcagagtctccgccaccgaccactacaacatctgtccctttaaaaaaggctccatcacagaccgcacagtacgaaacgccccgtccgctaaaatcttcttcgcctggtacacctaatttcttatattcagaaccagtaccaataataactactttagcttcgaactcgtcacccatatcagttttgacgagtttagtagctccgtcatctcgaatggattcgacactgccgtaagcatattcagcgccgaactgagttgaactttcgtacatatcttttgataaatccggtcctaaaacagatttaaagccaggaaagttttcaatatcagcagtattattcatttgaccaccatagattccacgatctagcatcactaccgataggtttgcacgggaagcatataaggccgctgtcattccggctgggccggccccaataataacaacatcatattgttttgtcattctctttcctccacacttttaataatgcattcactatacacttacttttaataactgtctatcattttgttttatataaaaaatcaaacgatccggtcaacccagaatcgcttgattttaaatacaataattatttttcttcaagttctttggctaattctttgatgtaggtctttaattcatcttttgtttcaggatgttttaaaccatattcaatattagtcttcaagaagccaaacttattacctacatcgtaacggtcgccattaaatactttggcaaatacgcgttgttttttatttaatgtatcaatggcatcggttaattgaacttcattaccttcaccaaggccttgtttttccaaaatgttgaaaatttctggcgtaagtacataacgtccgataattgctaagttacttggtgcttcatctacggctggtttttcaacgaatttagaaacgttgtataaatccttttcaacttcttcagaaggatcgataaccccatacttagatacttcttcatgaggaactggcaaaacagctaaagttgaagcaccagtttcttcaaaagaatctaccaattgcttagtcaacggaactttgtcttccattaaatcatcaccaagcataaccacgaatggttcgttgccaacgaatgatttagcagttaatacagcatcccctaatccacgtggatgactttgacgtttgaagtacatatttaagccagtggtttcttccaccatcttcaacatttccttcttgcccttagctttcaagttttcttctagttcaggaaccgcatcaaagtgatcttcgatagcacgtttacctttacctgtaataattaggatatcttcgattccagacttgcgagcttcttccacaatgtattgaattgttggcttatcaacaattggtaacatttccttaggtgaagctttggttactggtaaaaatctagttcctaatcctgctgcaggaataattgctttacgtacttttttcatgaatacctaacctccaaaaatttttactctaattctgacctaccgtcacgatgcatcaattcgtcgattgcttccttgacacccttttcattatacaatacatcatagatagcttcagtaattggcatttcgatatttttttgttgagctaattcataggcggctttagttgaaggaactccttcaatcaccattcccattgtatcaataacttcgtctagtttcataccttggccaagttcgttacccgcacgccagtttcgtgaatgcacactagttgccgtaacaatcaaatcacctacaccagataaaccgatgaaagtgagtgggtttgccccaaaggctactcctaaacgagaaatttcagctaaaccacgtgtgattaaagctgccttagcgtcatcgccgtaacccaagccatgtaatgctccggctccaattgcaattacatttttaagtgcggcacccatttcaactccgacaatatcgtcattagtatatacgcggaagtaattattcataaataatttttgaactgcttcagcacttgctaaatctgagctagctgctgtaacaagcgttaaatcttgcttagcaacttcttcagcatgacttggacctgaaagaactacaattgcttgacgtaattcactaggaatttcttccgctaatacttctgacaaacgcttatgcgttccaagttccaaacctttacttgcatgaacaataattggcttttgaccagttttctttaaaacttcaaccatttgttgggcaactaatcgcattaccttggttggtacaacaaacaataccgcatcaacatccttcaacgctacttctaagtcggttgttgctactaaacgttcgtcatacttaaaaccgggaacgtaatgttcattggagtgctgctcgttaagttctttagcttgttcctccatgttcgtccatgcaactacatcattgccattttggacaagcatgttagctaaaatactgccccatgatccggctcctaacactgcaactttttttaccatagttaatccccttacaatcttaaatttaaaaataatttatgtacctttctattatcgtatacaaaggtactttactcaagttcattttggtgaaagctgattaccttccaaataatctggtaggcgttctcgcatcgatttacggcggaacaccaatataccaattgctccgataaaaagtattaccgaaagccattgtgacacgcggatgcctaatagcatcaaactatcagtgcgcatcccttcgacaaaaaagcgaccaaacgcgtaccaaattacataggacaagaacacttccccttgtttgaataaatgttttttatgtctcaaactcatcaatacaataaagcccaagatgtcccaaagcgattcatataaaaaagttggttgacggtaggctccatcaatcagcatttgttgaataataaaatggggcaaatgaagactttggagaaatgttaagctagtaattctgccgaaagcctcttgattcataaaattaccccatcgaccaataccttgggccataatcaatactggagcgatgatatccaacattaaccaaactggaatccaatttgcacgacagaagaggtagaccacgattccagccccaatcaaggccccataaatggcaataccaccgtcccaaacgcgtacaatttcatcgacatggttttggtaatatccccactcaaaaataacgtaatacattcgagcggtaataatcgccactggtaaggcccataaaatcaaatcgtagatagaatctggatcgattcttcgccttttagcttcttgaactgccaaaatcgtcgctaacaccactgctgacgcaatgataattccataccaatgaacttgaattccaccaagattaaaggcaattggatttagtgctcctaacgttaaattcacaaaatccactcctatttctgggaattatctttgatcaactcatttaagttacgatcaaaaactttggttgcatcatatcccatatttttagctctaaagttcatggtagcggcttcgataatatcaccgaggtttcgtccaacacgaactgggatggtaatctttggaatatctaattcaaagaaatgtcgtgtttgttcgccgttacctaaacgatcgaaatgtgcatctttatcccaattttgtagatgaacaatcacactaatttccgtgtgatttttaaccgcgctcgccccaaataaattcattacatcaatgattccaacacctcgaatctccaaaagatgacgaagaatgcggggagcttccccgattaaggtttgttcatcttgttgataaatatcaacccgatcatccgcaatcagacgatgtccgcgtttgattaggtccaacgccgtttcacttttaccaatcccagagtctcccgtaattaaaacccctaatccataaatttccagtagttcaccatgaattgaatcacgttctgccaaccgatcttctaaaaagttggtcatgttacttagcagacgtgaggttggtaaagttgacgttaagatgggaacctgattatttttggcggcctggatcaattcttcaggaattggtaaaccacgcgaaaccacaaatgctggggtatcaacgtccgccattcgatcataaatcttagttcgttcatctttagtcatactatccttagcgtacgaaatttctgtttctccaaacagttgaattcgttcatgaggataaaatttaaagtaattggttaactctaaacctggacgtgaaatatcactaactgtaacttttttttgttctaatagttcatcgccataaaatacatctaatcttattttttctactaactcagatactgaaacaccatcggccattgaatgggcctccttcgctaacgatttgtaaagtggttcgaaataatagtattacaaatggataagattaccgaaatcaacatcgtcattccaaaggatgaaaaataaaaattagatgctcctacaaatacggaagttaattccaacatgagagcgttaatcacaatactaaacaagcctaaagttaacaatgtaattggtaatgaaataatttgtaggatgggcctgatactggcattcaatattgccaaaatcaaactagccaccaaagcaatccagatgcttgaaacatagaaatttccattactttggaaaaatccagtcaaagccacaaaaagaatgcaattaactaatactcgttgccaaaagcgcatttaaattctcccatctttattcgttgacgtcgtgttcttcaacgtttttaatttcttttctcttcttattattttgagactgaccgttcataccacccatataattactgaacatgctggcaaaaccttgatttgattcaattggtttactaggcattaaccaagctaaaataatatatgggattaacaaaagtccatgtgatactaacattaacatcaacataatcacccgagttagggctttactccagccaaaatattcggcaattccgccgctaaccccggttatcaaacggtcatttgatttagcaaattttgttttggaattcatattcaaatacttcacctctaaacattattgttaatagtaattttacagcttttgtctttcgtttagcaaactttatacaaaaaaacgagtagttattactaaatttttaatttagcaataactactcgtttcgtggtctaatcaattccacccacatccgcgacatctgcattaatttcggtaatctttcctgactgattatataatatccactctacaacgttggtaacatgatcgccaattcgttcaatgtagttagccaccattaaataccctgctcccccagtgactagtttggggttagttttcatattactcaaaacttcattacgaatttttttatagctattatcaatctgctcgttggctttaattacttcgtccgctaatttactatctctttttacgtaggcatccatcgtaacatctagcatcgttcgaacaacgttcgtcatttcagcaatttcggcttcgattttagcatcccgatgatgtcctttaattcgaatagtttctttagcaattccgactgcatgatcgccaatccgttccagttccgaactagcttttaagacgacaatcacctgccgaaaatcggcagccacgggttgttgtaaggccatcaattttaaagcttgatcttctaaagcaatttcttcttcattgacgttattatcataatcaatcacgctctgcgccatttctcgatcatggtcaataaatgatttagtcgcacggtaaatctgttcactaacgttaattcccatctccgtaaacttgcctaataggcgcctcaactcattatcaaaaatccctctcatgctagttcctcctatccaaatttaccgtttaagtaatcgctcgtctcctgtttttcaggatgtgtaaacatatcgactgttttactaaattccaccaagttgccatccaagaaaaaagctgtttgatcagaaattcgagatgcttgttgcatattgtgagttacgaccgcgatggtgaattgatccttaattgctaataaactatcttctacctttgctgaagataccgggtctaacgcactggttggttcatctagtaaaataatttcgggttgaactgccaaaacccttgcaatacagattctttgctgctgtcctccagaaaatgaaagagcattttcttttaaatgatctttagtttcatcccaaacggccgcctgctttaaactttcttccacacgttgatctaacagtgccttatcttttatcccactgagtcgtagcccgtaagttacgttatcataaaccgaaaaaggaaaaggattaggctgttgaaataccattccgactcgtttgcgcagttctaccgtatctgttttaggcgaatagatgtcttcgccatcaagtcggatggctccggtaaccgtaacttcggggtttaaatcgctcattcgatttaaagttctgatgaacgtcgattttccgctcccagagggtccgatcagagcggtaatttctttttcagggaagccgagactaattccatgcagagcttccttttgtccgtaatataaatgaacattttcagccgtaataatatcttttgccatatttttctcctaactacccaaagtttccagagacatagtcctcagttaatttaactgctggattagtaaaaatgttttctgtcgtatcaaattcaacaattttccccatgtgcataaaagcagtgtaatcacttagtcgagaagcttgttccatactgtgtgtaacgataataatagtgtattgttcttttaagtcatttaaagtcatttctaatttgtgggttgaaatgggatctaaggcactagcaggctcatccatcaatagaatatctggactcattgccagtgaacgtgcaatacatagtcgctgttgttgcccccctgacaatgctaacgcactacgtttcaaatcatccttgacttcatcccataaggccgcctgttttaaactcgattctacaatgccatcaatttttgatttgtctttaatacccatttcgcgtaatggaaaactgatattgttgtaaattgatttggcaaagggatttggacgttgaaataccattccaatccgacgccgcatttgataaatatcgacttcatccgcattaacatccaatcctcgatacataatctcgccatctacgcgagcaatgccgtcattcatccgattcaagcttctcaagtaagtggatttccccgatccagaagcgccgatcaaagccgtaatggaataacgagggaattgcaaagatgcatcctgcatggcatggttatcgccataatagacctgaaggttattcgtttctaaagcaatttcgcgatcggcggggaaggtcaaaattgatttttctttacgtttcgtttccaacatatgctttcctccaaattctatttgctggcagtgattctacgataaacataatttcctgcccaacgggccccaagattaaagactaatactgcaatgattaaaactgcagaagccccggcggaaacttgactggcatcgggcatgattccttcggtattaatcttccaaatatgcactgccaaggtttcggcaggacggaaaatattcaagggactgtcgccactaaaaggattccaatttgcgtagtttaatactggagcactctgtccagcggtaaaaatcaaagcggcggcttctccaaaaacgcgtccagcacttaaaataattccagttatgattcctggtagagcagcaggcacgaccactttagtaacggttttccaacgagaaagtcctaatgaaagccccgcctctcgttgtaaattagaaacaccatttaaagaattttcaatatttcgagttaacagcggtaggttgaagaaggttaaagcaatcgctcctgagataatggagaatcctaatttaaattgcactacgaagagtaaaaatccaaataaccccactactactgatggtaaggaacttaaaacttcaatggtaattcgaatagcttcagttactcgatttttcttcgcatattccgctaagtaaattccagctccaagtgaaattggaaaagaaatcaacaaggttagaaatagtagataaaaggagttaaagagctgatcaccaatcccgcctccagcattaaatgccgatgctggtgaggttaaaaatgaccaagtgacgtgtggtaaccccgtaatcaagataaaacctagtagagccactaaaattaaaataacgattccaactaatagataaataacggctgtagcaatcttatcaactctcttagcgttcatttaaaatgctcccttctttccaataaaccttgttaggaggttaaataccaaggacattagtaagagcaccaatgctaatgaccataaggcattattaggtaaggtccctaaaactgtatttccaattcccgttgttaacacactagttaacgttgaggctggtgatactaagtcacttggtaaaatcgatgcattaccaattaccatttgaacagctaaggcttcaccaaaggctctagccattccaaaaataatagcagttagtaagcctggaatggaagctcgaatgataactttgtagattgtttgccaccgtgtggctcccaaagccaatgaagcctcgcgataaaactgtggaacagcttttaaactatcaacgtacatggaagttacggtcggtaagaccatgacaaacagtacgaaggttcccgacaaaattccaaaaccagttccaccaaatactgttcgagtaaagggcacgacgaccgtcaacccgataaatccgtaaactactgatggaattcccaccaacaattcgatgaccggttgtaaaattttacgtccacgttttcctgcaatatcaaccatgaagatggcggtggcaatcgcaaatggcgctgccaaaagggctgaaagaacggtaacactgaatgatcctacaatcatcggtagtgcgcccactaacgcttgaggtttagcactcggattccaaacttgcttagtaaagaaatcaacaatactcattttattttcgaagaaagttgctaaacctttagaagtaatcatgtataaaattgaaaggactaccaacataatcaaagttacacaagctaaggaaattaactttccatgctggtcctgcctggaagcctttgatttacgcgttaattctttttttactgcatccattattcctcagctcctttaattgggattacttggtcatcacttgttagttctaccttcatatcatggattgaaatataacctaagtctgaaactaaattcttttgtactttttcagatttcatgtatttaataaagttattggttgctgcactggcattaggtttcgtatacatgtgctcatatgaccaaattttccaacgattattttccacatttttagcgttaggttgaactccatcaatcgctaaatgtttaatttggttattaaaatatgagaatgaaagataactaatcgatcctggagttgcttgtacaattttttgtaccgtcccatttgaatcttgttcttgagcattcaaagctggttgtccttttaataccactcgttcgaatgatttccggataccactcccttgggctcgattgatgaccacaatcttttgatcaggcccccccagttgtttccagtttgtaattttacctgtaaatactttacgtagattagccatagaaatatttttaattggaacatcttggttgaccacgggagccattccaaccaccgctaccttatgatccaccacttttttggcatcaattccatcttgttgttctgcaaaaacatctgaatttccgatacttacggcgccttgttgaacttggcttagaccggtcccagatccgcccccctgaacagtgatatccacaccgctattttttacttgataatcagcagcagctttttctactaatggttgtaacgccgtcgatcccacaatcgttactgaatttttttgagatgacttagactgacatccagtcaaaatcaagagtattgccatcatcgacgctaagataatccccttattaacttttttcatgtcctggcctcttttccctaatctctagcttcgattattagcatacaagggcaacgtaaaggttaaatatgaggtatgtaaagattatgtaaagaattttaaaatagtaaaaagtgtaaaaaaaataaagccgaattaaaattcaactttattccacaatatttaattaatatcacgcttgaattttacgatcaccgtggttccgctatcttcatctgattcgattcgaacgctaccattcatatcgtcaaccgcttctttaacaatggctaaacctaatccagtaccacctttagtagcgttattcacccgataaaaacgttcaaaaacgcggtccgtctgacctaaaggaattccaataccagtatcactcactacgagcttccaacggccatgatgtgatccgtaatcaatcttgatttttccaccttttcgattgtaactaatcgcattagtaatcaaattcttgacgatttggaataaatcattttcaatcacttcttcattaacatctgctggaatattgttttccacatgtagattcatgctactgatgttactttctactaacttaagttgttgatccacatacttatgtaaattaatttctttacgttctcgttcaccactcttaacgcgcgacatggttaaaatatcgtccgttaattgcactaacttatcactttcagccttaataatacgtaagaaattatccaaggtttctggatcgtccttggctccgtttagtaacgtatctgcgaagcccgcaatcgatgtaattggtgtacgaagttcgtgcgaagcattgttaacaaagtcacgttcaatttgtttagagcgcaccgtttccgttgcatcgtaaagtagcacaataatttcaaatttatggtgcactttgggactgtaaacaaccgttgtttcataaatatatggctggtccccatctagtttaattgttttggtagtactctgacgtgttctaaacacgttatccaccaattcacttaattcatgatcccgaatatccatggtatatgggtgaggaacgtcgagtccagtaatccctaagtggttaatagcgtacgtgttagccacttgtagttcacggtgccgattaataactagcactcctactggcaaattatccataatggcggttaattcactttgttgatttctcaaaacgtgaatttgatgacgctcatgggtaccaatttcattaacaactttagataatttataaaatggatcttctggatccaattgaatcttgggaacatggttacctttaataacttcttctaagttctttctgaataacttttgacgctcaataattttcttttgattactccaaaatacaattatttcaataaccgtaattaataaaatcacggcgattaacagtgacatatctaccttagttactcgtggattttcttttacaattaatttatacaccagaaaagccataaaggcatttccgattagactagcaaaaccgaattgcacggtacgcttaatcgccttttttcgagacgaactcatatccaaaccccctaatggttttgatcaactgtggatgtttgggatcattttccagtttatccctcaaatgactgatgtggatatctacaatacgggtctgtcccccatattcatatccccaaactttctccaaaatttgatcgcgtgataaaacttggttggcatttttgtataaataccttaatagtttaaattcattgggtgttaattgaattttttcattattcttcttaaccaccattcttttgaaatcaatggcgatattttctgcttgtagagttggatcaatttcagccaaattaattgcccgatcagtccgtcgcaagattactttaatccgtgaaagaagctcctgaggactaaatggtttggtaatataatcatctgcccctaattccaatcccaatattttatcaacttgactagtcttagccgtcaacataataattggaatttgttcatcaaacttgcgaatttgtttggtagcttcaattccatccaattgagggagcattaaatccataatcacaaaatcaactaagcccttttggacgatttccaccgcatctaaaccgttatccacactcacaacttgataattagcttgttccaaattataagtaattaaagtcacaattgctggctcatcatctacaactaatatcgtctttgacatccgaatccccctattttggattatcttctttcaatttccattgcaaataagcattgataaaatcatcgagatccccgtccatcacaccttgaacgttagccgtctcaaagttgcttcgatgatctttaaccatagaatagggatggaaaacgtaagaacgaatctgcgatccccatcctatttcaagttgaatgccttctattttagccttttcttctgctttcttttgttcttcaagctcaaatagcttagccttcaacatactcatagcggtagcccggttttgtaattgagaacgttctgcttgactcgcaactacaattccagttggcaaatgcgtaattcgcaccgctgaagaagtcttgttaatatgctgtccaccagcaccactagaacgatatacatccacccgtaaatcatcttggttaatgttaacttcaaccgaatcatccaattccggcataacgtcgactgatgcaaaagaagtatgccgtcgtccagcagaatcaaatggtgatagtcttactagccgatgaactcccttttcagagcgtaaataaccatatgcgttgtgaccgacaattcgcatggttacactactaattcctgccacttcacctgcttggtaatcttcaatttgaaccttaaactgatgctgctcagcccaacgcgtgtacattcttagcaacatggaaccccaatcttgagattctgttcctcccgctccggggtgaatttctataattgcgttattggcatcatatttaccattaagcaataatcctaaacggtaatcctgcaataatttagccgtggcggctaattcactctcaaactcactttgaacgtcaggatcatcttccatttccaataattcagcagttacctctaagttttcaacatggtcggttaaatttttaaaattatcgtatttttgttttaactcattattttcattgatgacaatttgagcctgttcttgattatcccaaaagttaggctctgccattttggcctcattgacactgatactttcattcaaagcatctaagtcaaagagacctcccgaagtcagcgacttcttttttcatatcttcaatttgatgttttgcttcaactagctccatataagttagctccttttttcatttcacattaaaaaactgggaacggtcaaattaccttcccagttttatattataaatcaactaccgttgaagattttgacgaatttcagatttcataaataatcgagtagtttcatattcgatatctgtaatcatttcgttgaacattcggtaaccttcttgttgatattcaactaatggatttaactgtccatagcctcgaagtccaaccgattgacgtaactggtccatggcatcaatatgatcggtccagtgttggtcaaccactcggagaatcacaactttttcaaattctagaatttgagctgggtcgtacaaagctttttctttttcaatgtacatttgatcagctagttgtttcaagtagtccttaatttctttagcagacatcccttccacatcagcttgatgaatgtctttatctgaaaccaaggcagtccgtgcaaattctacaatggtttctaaatcaaagttcttttgagttttttgggtatgggcatcaaccacgcggtcaatcgttcgatcaaccatcggcattagcacatcttttagactagtttcttccatgatcacttgttgacgttcagcgtaaatcacttcacgttgcgcacgcataacatcatcgtattgaagaacgttcttacgagcatcgtagttattaccttcaactcgtttttgagcagattcaacttgacggctaattaaaccacttcgaataactgcatcttcatccgcaattttcatcctagaaagcaaatctttgattcgttctgaaccaaaacgaatcatcaagtcatcttctagtgaaagatagaattgggacattccgacatcaccttgacgtcccgaacgaccacgaagctgattatcgatccgtcgtgattcatgtcgttcagtaccaattacagctaaaccacctagttcaactacgccaggtcctaatttaatatcagtaccacgaccagccatattagtagcaattgttaccgcacccttttgaccggcgttggtaacaatttcagcttcacgggcatgattcttagcattcaaaacaacatgtggaataccttctcgatcaagcaagcgtgagaggtattctgaagtttcaaccgcaaccgtaccaactagaactggttgacctttaatatgcaaatcacggatttccttcaccactgccttaaatttactttccaaagttggataaagtaaatctggacggtcatcacgagccaccggacggttggttggaatggttgtaacttccatattgtaaatttcacggaattcttctgcttcagtccgagctgtaccggtcatccctgaaagtttacgatacattctaaacaagttttgataagtgatgttggccatagttttagccccatcttgaatttcaacgtgttccttagcttcaatcgcttggtgcagtccatcagaaaaacgacggccttccattacacgacctgtaaaagaatcaacgattaagacttcaccatctgaaaccacgtagtccttgtctttagtcataatataatttgctcgaagagcttgatcaatatgatggttcaacgcactattttcaacatcgtagaggttgtcggttttaaagaagtttcccgcacgacgaatcccattttctgttaatgagatggattttgattcccaatcaatcgtgtaatcaccatcagccaaagtcttcacgtaacggtcagcacgttcatatagcgtaacagttggttcagtctgaccagaaataatcagaggtgtcctggcttcatcaattaaaattgaatcaacctcatcaatcaaggcgaagtttagaggacgttgtaccatatcctctttatacacaaccatgttatctcttaagtaatcaaaaccgatttcactgttcgttgaataagtgatatcacaattgtaagcttcacgtttttggtcgggagtcatttctgaagaattaacccctactgttaggccaagccatttataaagctcacccatttcacttgagtcacgttcagccaaatattcattaacagtaacaacgtgaacccctttaccacctaaggcattcagatacacgggtaatgtggccgttaaagtcttaccttcaccagttttcatttcagcaatgttaccaccatgaagtaccattccaccaattaattggacgcggaatgggaataagcctaatactcgcttagctgcttcacgtgcgactgcaaaagcttcaactaaaatatcatctaaagtttcgccattttgtagacgctctttaaactctgtagttttagccttaagtttttcatcatttagttgttccatttcttcttttagggcttcaatcttatctgcttttttaccgagtctttttaactcacgcgcatcactttccacccatttttttaaaatgtttgccatgtactatttccttccgtactaacttaatcgtaaaaacgataacctgtttaagtttatcatttttattattacaatcaaactaatcttaaatatatttaaaaagcttaacaaaccgttggaagtttgttaagcaattttgttttgtatttatttagcggatctaatcgttagcagattcgatcaaaccatagcgtccatcgcgacggcgataaacaatatcaactgatccactttctgcatcttcatagataaagaagttatgtcctagcatgtccatttgcaagattgcttcttcacttcccattggtttcaaggatacttgtttagtacgaacgatatcaaattgactggcttcctcttcgttctctacaatatcaccactagggatttcaacccctttgtatcctgtttcacgcgatttgcggttaatttttgttttgtatttacgtagttgacgttccaatttatcagttactaagtcaacactcgcatataaatcaggcgaagtttcttctgctcgtaataccaagtatggcaatggaatcgttacttcaaccttagccgttttgtcttggtatactttcaagttaacgtgagcctttggattggcaccttgttcaaagtatttttcaatcttaccaattcgtttctcaacataatcccgaattgcttctgttacctcaatattttcaccacgtacattaaaatcaagcataagacttctctcctttcaactgtggataaactgcatccactaacagaaatatatattctacttcatgtatttctgtacaacttcattataaatgaaaacgctacaataaacaatgaatatacccaaataactaccgacaaagcgtgactgaacggacttgggtcgcgccatttcttagtaaagtggtccgagcttgtcgaagggtggctccggtcgtataaatatcgtccaccaacaaaatatgttcaccactaatatcacatccgcttttcaaaataaaagaactatcttgctgtagtcgctctcttcttgaacgttgaaattgatgtaaactatcgtttgagcgctgattaatcaaaacatctttccaatccagaccttccatcaatccagttacttggttaaatccacgtgaggtcattgtactctcatcaactgggatcggaacaatcaactcgttttctttaaggatcttttgaataaaattaacaaattgatcttgaaaaacttttctcagtaaataatctccctgaaacttatagtgctgaaaaaaattacgcatcgcctcatcatattgaaacatggctcgatttacgaactgatcattccattgttgacagtccgcacactcgagaattgctgaaagttttccacatctaatacacgttttgtgatctactaatgtggaaaaactcgttatacacccctcgcaaactaacttcggagtaatttttctgaaacttaaaataaaagataaatctaaattattatttaatcctcggttacaaagtaagcaacttttcaacattcactcgcctttcgattcataaatttgatttgggcttgagctctttttatatttcgatttaacattggacaaataaataatacagtccccttgggtcgttggggacttcgaccaactcgaccagcaatttaaaccaatgctgccatggaaaagacggcatcatctgctcctaaaacagcgacatcaatacctggaaaagtcactccacgttcaagaatagtggtcgtaattaaagcgtcaatttcctgtttacgcatcatttgcactttagccacccgctctggatctgctgcgtgaactgttaaaactttgaccgtgggaaagacctgttgcaaagcctccaatactttcggtagcacctcaattttgggaacaaagattaaaaattggcgctgtgcttgaatttgttccttaataaatcggcttaatgggcttggcaatcgaccctttcttaacttttttatccaattttgcccactcactactttaatttctggtagtggatgtccatgaaaacgccgagttagataactggtagctaatttagcttgccgactttgctgtaaaagttttccgtccggggtagctgtaagataaatggtcgatccttgtaatttacgggcctgcttggttgcataatgcagctcaggattcatcgcatagggaaaagaatccacttcatcaatgattaaaacatcaaaggcgtggtaaaatcgtagtaattgatgcgttgtacagagcacaaactgcgtatattcatagggagctggggatcgaccgtgaagcaaggcaattttagcctgtggaaaagcttcttgaaatcgaggaaacagctctaagactacgtcaattcggggcgaagccacacatatccttttttgcttttgtaaagcatgattaattcccgggaagagcatttcagttttccctgccccagtaaccgcccagagtaaacgattttgttgctgatcaatggaattaataatcgcttttgaacagcgagcttgcggagcagttaacttccccggccattctaaataactctgattcgccacaaaattattaggctcaggaatggtcgctaactgaaccagggtagaaactctacctaagttgatacatctacggcaatagaattgatgatctggtaatgccccatccctactagaggtaattgcgccacatcgttggcagtgaatttgatttcctttcattacaattgctggtcgacaatcaagcgaatccgttggtactgcattaattggctgtaaaactagccgtccatagtatttttgcttttctatttcttccatatttattaaatacccaaaaaggagtctttttcttgaaaccaatcttatccgtcaaagaaaattttaaaattgaacaagatatcaaaaaatcaagatttattagtcggattattcccattcaaagtgaagaggaagccaatcaacttttaacggaaatccgcacaaccgaagctaaagctaatcacaactgttttgcctacattttgggtgaccagcaagatatccaacgggcctctgatgatggtgaaccttccggaacagccggcgctcctatcctagaggttttaaaacgcgagaacttaactaatgtattgatcgtcgtgacgcgttacttcggtggcattaagttaggagcaggcggtttaattcgcgcctatggatcaagtacttccctagctgttaataatgctgctttgattcaacttgttgatcaagagcttttatcgattaaacttgattatcaaaacaatgatcaattagtttattatcttgaacaacatcatttaaaccagttagaaacggaatacactacccaagtaactactactatttcaatttccaaagaacaattagaacccttaaagcaagaactaatcggtctttttagtgggaacgtggcctttaaggatttaggtaccaaacgagttcaaattccatatcaaaaaaatgaggatgacaacgactaatatcgttattatcctcattttttatggcgttcactacgtgtgcgaaccttatcttttaaagtgttctcttctttaaattcattactatctactttagaagtattagagcgtacgagctttcgaatccaatttagcattggcgtacggttttcgcccactaatccaattgcttccacaaaaatctcgattccaatcaaaattccgatggttaataacactgagccccacaacgtagaaacgggatatagcagcgcaataaaggaaaagattagtgaaattccataaatcactaacactgtttgtcgatgggttaagcccatttgcatcaaacgatgatgtagatggcgtttatcagcgtgtgaaatagattccttatttaataatcttctcaaaattgcataaaccgtatcagtcaatggcacacccaaaatcataactggaattaaaattgtgataaaggttgcatttttcaaaccagatagtgagaaaattgaaatcataaatccaataaataaagctcccgtatcaccgagataaatccgtgctggaaagaaattgtaaggtaaaaaaccaatttcagctgctaccaaggtaaaaatcatgattacaatgtagatattagtagatggtagaaagaatagtccggtaaatcctgtggtaaacaacgcaatgattgttaccccagtcgctagaccatctaacccatctaataaattaatcgcatttgtaatagctgctatccatagcaacgtaattggtaacgaaaaccacccgaagttaacaattccaataaatgggaaagttaacgtcgtcatccgaacgttagcaaatagatacaccgctaacgccgctaacaagattccaatcattttttgtataggtcttaattcaaaaatatcatcgataattcctgttactaaaataatgcattccccgaagaaaattccgtaaaactgcggattaggtatttgatttctcaataagaaaaataatgagaaattgaaggcaatgaagattgccaatccccccatggttggcattggtactttattgactcgcctggctgtcggtttgtcaatggcaccaactttgaatgaaatcctccggacaaatggtgttaagatcgccgaaatgatcattgtcgcaaataaactaacaattatttcaaatcgcataatttgtcctctttttgttcgtaataagcacattatacctaaactcatgagccttatacaatcttcttcactaaaaatgcaaagaatttaaattattttttcatattttgacacaaaaaaacctagcctcagctaggttttactttttatttatttcagatggtaattataggttgagacaataatattctcacgcgagttcaaagaagcacgtaaacgcaaaccagtttggttatgcaaaatattttgccatggttttcttggaacaaactgtggaactaacacagtagttgtgtagtttcgttcagccgcacgccgggcaatcacatcacagaaacgtaaggttgggttcgtaattgagcgataagatgaatggatatcaatgaaacgtacatctggatattcagctttaaattccatcgcggtcttatgttctttttcaggattagcatcaaaagagacatgcattgcaattacgtagtccccgattgaacgagcgtagttaattgctccagaagtaacttgagtaacgttgctaactaagacaatcacagttgaaccatcatagtcatgcaagttaactttacctttttcaattactcgtaattgatcagcaacttcatcgtaatgtttacgaatcttgtagaacattcttaacaagagtggcataacaataaagtatggccaaacattgctaaagtgtaagaatagcaaacaaattactaaaacggctgatagtaaagctcccagcaagttagcagaagcatttatcatccactttttaccgccttcacgcttccaatgaacaatcattcctgattgtgacaatgtgaaaggtacgaaaaccccgatggcatacaatggaatcaatagtcctgtttgtccaccaaagattaaaatcaaaacgattgctccggcagccaaggaaataataccgttggaatagcctaaacggtcaccacgatccatataagcatgtggcataaacttatctttagctaagttatatgccaacattggaaaggctgagaaaccagtattagcagccacggccaaaatcaatgccgttgataattgaaggatgtagtagaaaataccatgtccaaaaattgtcacaccgatttgagataaaacggtttgagaagaacttggtgtaattccactgtagtatgccaagaacgtaattccagcaaagaatgaagctaaaatcaatgacataatggctaaggttcctgcagcattcttacgacgtggtttcttaaagttaggaacagcattactaatcgcttcaaccccagtcagagaagaagaaccagacgatagtgctctaaggaaaatcacaaaagtcatcccgggcactgccgatcccactgcggaagtcgcatgataagccacttgaccagttgcaatgttgtataaaccaaccacaatcatcaaggaaataaccacgataaataggtaaaccggaatcgttaagaaactagctgattctcgtagtccccgcaaattcagcgccataatccccagtacaatcaaaaccgcaatggcaatatggtacttttgcaatgctggaatcgccgacgtaatcgcttctgtaccagaggtcacactaaccgctacggtcagcatgtaatccactaaaagtgagccaccggccaccagaccggccgacgtcccccaatttttactagctactacatacgccccaccaccagatggataagccttaataatttggcggtatgacacggtaatcgcgaataatagcactaatacaatcccagcaattggaattgaataccaagttgcagcggcagataaaacaatcaaaaccgacaaaatttcttcggtaccatatgcaatagatgataaagcatctgaagatagcaaggcgagggctttgaacttcgttaaagcttgtccactctcgtcgagcgttttcagtggtttaccaattaaaatacgcttcaaatacgaaaacatcttttactctccattttcaaaaatatgcaagtgaaattctactccaaatctcgcaaaatgactagcacaatttttaagattataattcatatactgataataacagaattcatctgaataaggtgtaatttaaacgtaatattcctcagtccagtaaagaagtttttcaacttctaagttattctaattcatattctcctagttggaaataaaaaagaatccacaatgctgatcgcatcatggattcttttaatttaaattagtctagtttagcgttggagagctgaattttcggcaaaccttcgcatcttcctaatttaaatcgttagttctaagaattaaattacatcataccgcccatacctggagctggtgctgcaggagctgggttgtcttctggtaagtcagcaactactgcttcagtagttaacaataatgctgatacactagcagcattttgaagtgctgaacgtgtaacctttgtaggatcaacgattccggcttcaaccatgtcgacccattcgtcgttagcggcgttgtatccaacacctggcttttggcccttaagttttgtaacgattactgaaccttcttcgccggcattttcagcaatttgacgaactggttcttcaagcgcacgacgtacaatgttaacacctgtagcttcatcgccttcagcttcgacgtcttcaaggtctgaaataacgttagcaagtgctgtaccaccaccaggaacaaaaccttcttcaacggcagctctagtagcgtttaaagcatcttcgatacggtatttcttttctttaagttctgtttcagtagcagcaccaacacggattactgcaacaccaccagataacttagcaagacgttcttgaagtttttccttgtcgaagtcagaagttgtttcactgatttgttgtttgataattccaacacgttcagcgatttgttcttggcttccagcaccttcaacgatggttgtatcatctttagtaactgtaaccttgttagattgaccaagttgttcgatagtaacgtccttcaagttcaaaccaaggtcatctgtaattacagtaccaccagttaggatagcaatgtcttccaattgttccttacgacgatcaccaaagccaggagccttaactgcaactacgttgaaggttccacgcatcttattcaaaacaagtgttggtagagcttcacctgtaatgtcatccgcaataatcaataatgaacggctttgttcaactactgattgaagaactggaagaatatcttggatattaccgatcttcttatcagtgattaagatgtatggattatcaaggttagcttccatcttgtcgttgtcagttaccatgtattgtgacatgtatccacggtcaaattgcataccttccacaacatccaatgttgtgtcaactccacgagattcttcaatggtgataacaccatcgttaccaactttttccatagcgttagcaatcaacttgccaacttctgggttagcagaagaaattgaagcgatttgagcaatatcatctttagtttttacttcatgtgacatcttgtggagagctccaactgctttacttgttgctttttcaataccgcgacggataccaacagggttagcaccagcagtaacgttcttcattccttcattgacgattgcttgagtaagaaccgtagcggtagttgtaccatcaccagcaatgtcgttggtctttgaagcaacttctgaaactaacttagcacccatattttcaaaatgatcttcaagttcgattgccttagcaattgtcacaccatcattagtaattgtaggtgaaccgtatgattgttccaagaccacattacggcctttaggtccaattgttgacttaacggtgtcagctaacttatctacacccttaagcatttttgtacgtgcatcttctgaaaatttaatttctttagccattatcaacactcctaaattaaaaattaattattcaactactgcaactaagtccttttcatggacaactaagtattttttatcttcgtatgaaacttcagtaccagcatatttgtcatatactactgtatcgccaactttgacgttcattggtactgtttgaccattgtctaaaactgtaccgttaccgacagcgataatctttccagtttgggacttttctttagcattgcttgcaagtacgatgcctccgacagtttgttcttcttcatctttagcttctaaaataacgcgatctcctaaaggttttaacacgtgaatccctccaaatataatttactgataagatttgtttagcactcgtcatctctaagtgctaactacaatgataactatatcatgatttttttagattgcaagtatttttgacctttattaaccaatcaaatttagcaatactttaaatatgctatactagcaggaataaaggagggttgagatgaaaatttctaagagttcaattttaactttaattacgtatttaataattttccttctacctagcattttaaacgtgtttattaatctgggggctgggtttatctgggttgaaactgtcgactacttggttggcgcactgctactaatctttattagtagtaaaaccaacgaaatcaaccatatcgaatctaatcgtaaatcttttctatatgctattgcttggggaatcattggaacagccttagtaattttgctgcaatttgtgattagctatattacgatcatttttggaagtaatcctacttctcaaaacaccgcaactttagtgactttggctaaaaccaatccatttttcattttagcgatcaccgtgggagctccaatcatggaagagttggtttttagaaaagttttatttggtaacctcagtgcaatgtttggatctgattccacgctgggattcaccgtcatggccatcatttctagtctagcatttgcatttatgcacaacgatagtcacatctttctatatgcggccattggtttgctattctgttggttgtacaaaaagaccggacgtattcaaacttcgatgattgctcatattttaatgaattcggtcgttattttaccgttagtaattaaataacaaaaagaatcattttagtttcactaagtattagtggctaaaaatgattctttttaatttgttattttggactgtcgaactagttgtggaaaattgtaacagctggctaagccgttgcgggggtataagtctatatttgatgattttgatttaacgtgtttagtttcatttttgtaattttacacctccttccaatacttttaaacgtttacaacaccatttttatagtgtttaacctcctttaaggtaatgaccatatatgttagaatcaaggcaggattattgtgatttacaaataattatgggggagtgttttattatgaaaaaaattgcttcaattgcacttttagcattggttccactgacgcttgctagctgcggatctggaaaccaaaaaccagattctcagtcttcaaatgctacttctaaaacagaaaaggttagcaaaaaggctagctcaaaagctagttctaagaaagataaagaagcttcatcatcttcaaaagcaagttctaatagttcatcttcaactaaggatgatcaaacttcatcaagcgttgctagcgcaagtagttctacttccaaagcttccaatagtgctattagttcctctagtaagtctgaaaataaccataatagctcaaataaaacgagttctaacaacctaagtcgtgcagatttaactgccgctgaacaacaaaataatcatcaaccgttagctgatgaaactatccaaacttctgaggcggccatcaatctagttaaagccaaatatggcgataagggttggaaagtagcttatagttccgttggtaaatcctcccctatttatttccacgttacttccgaccatgatggttcatattatgtctacgctaatggagtcgttcaaaatgccggtggtgatttatctgaccacgctagcgaaattcaaaatattaaataaacaaaaaaattcaaccaacgtcgttaaacgctgattgaattttttattttatgcaattatcttttcgatggctgtattaacagctgctttttcggcttgtattaacttcactcgaccttcaatgactttaatgtccattgtaatttcacgtgttaagcctggcgtttgcaatttaggttcgaagaaggctttgaattcctccaaccgtgctggtgttctaaatatattagcaatcaccgtgatgaaggtattaaattccatatcaccacccacagtatcttccaaccatttccaatcatttcgaatccaatcccaagttaattgttgccctttagcattagctaatagacctcggaaccaagctcgcaaatcttggggtttaatcgtgctagcatcctcaaatttttcaataatagctttgatttgcttttcatccgtagtagcagtgagtgctctacttaaatcagctttataacttggatcagtcgattgacggtactgttccattaactggttaaatagtcgttcgttattaaagtttttcacttcgttactcaaaacatgactacgaatatcggctgacaagttggataactgattttgattttgttcaaaaagttcatgtgctgctaaaattgcttcaggattcttcgcgtataatgcggctcccaatacataaggtcgagttaactgatcatcattactttccgcggcccttggtttccaacctaaacgttgtacctgttttgcactaagttgattgaaaagtttttgaaggttcgcctcttcttcactatcaggctgaacaaatttcttcaaatcaccagccaagcgatataaaacatcgttaactaccgctgatgaactatcagcaaatttttccagtagcggtacaatttcagcatacgaaatttgatttccttcagctaataatcttaagtcttggagaatttgcagctgatcaattgctcctagttggtccaatgctcccaagatatccgctaataaatccttagcataatggacgatgaaatgagattcgttgccaacattgagtcggaaaggttgcccattttcatttcgaagctgttgataatcgcctaacgataaagtaggttgatctaaaatttgaggaacgacttcatagttaccttttaatgggatttgccattgccgtcctgcattttgtccttcaccaatgaaaaattgttgttgactaatagttaattggccatcgaccacttcaacattcactacgggataacccggttgttccaaccatgagtgcatgattgctccgacgtcaatccccgcagcgtctcctagagcagcccataagtccgccccttttgcatttccatactggtgattattaaaatactgcttcaatccggtacgtaaagcgtcatcgccaatcaaggcccgcaccattactagcatacgtgctcctttagcatacacgatggctccatcaaatagcgcgtctatctcagctgggttttggacctgcacatgaacagactgtacaccatcagtagcatctcgctgtaaggctgcaggaacatcggacgtttggaacatttcccaaatatgccaatcaggttcaatcgcatcaattgctacgtattccatcatattggcgaaactttcatttaaccataaatcatcccaccattgcatggtaactaaatcaccaaaccactgatgagctaactcgtgcgcgatgacggttgccactagttgtttagtttctagagccgtgttcttaggatctaataaaagataggcttcacgatatgttactagcccccagttttccattgctccggctgaaaaatcaggtagagctagttgccatgaatggggcaacggataagctgtatggtagaattcttcataaaattcgattgaacgtttggcaatatcaagtgcaaaatcaagttcttgagcttgatgagctttagtagcaaagactccgacttgcacgccgctagtcgtctttgtcattttactttgaagatctccaaaagcaaaagcgattaaatatgtcgacattttaaccgtcgtatcaaaataatgaattccatcgactaccttaatttcaggcatattacttaaaatggtttctccatcatgttcgtcatactttattgctaaatcaaaagttgccttagcctctggttcatcaatcccaggaaaggcttgtcgagcaaaagttgtttcaaactgggtaccaaccaactgtttttgaactccatcgacttcatagtatgatggataaattcccatcatgctgtccgttagttcagcttcgtattcaacagtcaaagttacattaccagcttgacttagttgcagacgaatcacttcatttgctgaatcaatttcaaaaggcgttttctcatcattaacataaaccactttaacttctaaatccttttggtgaagggcaatttcggtctgctgggctatcccctgaatgaccgttttaccacgaaaatgcttagtttcacggctgatatctaaaaatatatcgtagtattctggttgaaataaatcataaagacgcgtaattttagccatagttttctccttattttataatacaattttaattatacaacttcacgattaattcgtctgtttaatttgcttatctaaatttaccaatcgatgaaaaaagcccaagataattaatcctaaaataacaagtagaataaacgcccatccactgcccgcactgatattttgggctctggtgtaacctggatgatgaactgcacccatcattaacgctaaaaccgtcgttccaatcgcaccagccacctgttgaccggtgttatatagcgcattagcgtcattttgaagttcttggctgatatgttttaaaccataggcaaccgaattaccaaacgccatagaacgaccaatggcgaaaattaagtatgctatggtaattcccaatactcccatatgtggtccccaaagggctaaggatgctagcgctaaggtaaataaaatatcacccatatataatggtaattttccgccaaagttatctaacatccaaccataaactggttgtccaaatccatttaatagactccctggaagcaaaatcaaaccaccaattaaggatgtcgcttggaatacatcttgaacgtagttgggaagtaaaaagttaatccccacgttagcgaattgcaacattatatatggtagaaaactaaatagaaaggccttatttttgaatacgtctagtgaaaataaagctttagtagcatttttagatttttttacaaacagcgttgttaaaccaatactaagtaatagtaagacgataaatgaaatataagcgcctgaccccaaattattgagtccaacaattagggctactagtgccaaccctaaaagaataaaacgtatccaatcaaaagcatactgtttttgagttggggtatattgtttaatttttttagaccctaaaaccattagaatcaatgcaatcggtaatgttccccagaaaatcattcgccaacttgcaaaagcgaccacggcccctccaaaggttggacccatggcaggcgcaattaaaataattaaattggctaacccaatataagttcctagcttgtgttggggtacaacctctaaaattatattaaccattaaaggagtacataaccccacacatccggcttgaattaaacggcctaccaagagcacccaaaaattcagcgctgcgccacagataacatctcccaatccaaataagatggctgctgccacaaataactgtcgattggtaaatcttcttttcatgtaggctgaagttaacatgactaacgcagccattaacaaatagcctgccgttacccactgcactgtacttaatgacaccttaaattctcgcatcaaagctgggaaagtaacgttcattgaagtttccgttaaaactcccataaaagacatcagtgccacaatcgccacaactaccatcagattggatttttttgttgatgattcttgcattaaaactcttcctctcaatgttactttttaaaagtacataacttctataatggaaataattgaaagatttgtcaaattggttcatcaaaaaagacgtaacgttgttttatcagcgttacgtctttcattaaattaatttgttctacttaaatttttaagatacttgtgttcaactcttcgacgtgcttccacagcttcttcgaaatctagcatttaaaactaaatctcctttatgcatcattcgtgcaacccatttttgtgagggatgatcaaatgaaacaccgattacaccactagtatttctagctccaatgttaactgcttgaaccggattcccattccgatccttgaaagcattactgtttccaatttgttctgccgttgctgcattctttcgaattgtttgagcagccttttctttacgtaagcacccacagctttttacgttccctgttcgtaaacggtaactgtcggcctcaatcatcttgccacaaacacaacgacataaccaataaatatttccattagaactgactttatccgctctacccagaaccgttagtcgagcaaattttttcccttgtaagtcatatttcattctggaacaatttccacaacttttgtgccaccagatttaagatgctgtaattcaacatctttttcttgtccacattcacatacacagtgccatttagtattcccattttttgctttccctgatggatacttagccactaatttaccaaatttcttacccgttatatctatccgtattcccacgataaactctccttatattcttactccttttctttggcttttttaatagttaaataaaaaagcacttccctgctattccaaccacatgttcttaattagaatgctaatgaaaatcagtaaagcttcccaattctttactgttcatcttgcactctaactttgtatagcattatatcccataaaacattaaccctaggatattttgctcaagcaacctaacatgcacgtattagtatacaaactcacaaattagtgtgtcaaccacatttctagatttatttgtagaaattaaaaaagtaattttttccaaaaaaatgataaattagcgataacttatttataaaaataagtaagtcttatttaagcatctttaataagagttagtgaatatacgttcaaaatttgaagaaagcgtattaacaaacacaacatttgcggtataatatactagcacgcgtaaatcaatgacttataatttaatttataaataagaatttcattataaaaattgatgataattcaaagaaaaatatctaaaatatctattcgaagtaactaatgcttcatttttatgtaagccgatacaaaaaatggataaatttacatttattcattttttaaatcaataatgctaagaaatatatctgtatatttttcacgcgtttcggcatctaactttaaaaattttctaacaaattcatcacttttcttatctaatttactgtgcttaaaaacatcccctagctctagatcaagagcgtgtaagatactttctagttttgatatagatacgtcttcacgttttccacgctctaatctggcaactaaatcaatcgaaacatccgccttttctgctaattgttcgattgttaaattttttctttttctgttttttctaataaattggaatctttttaccatgcagtaaccaccttccaaaattaaaactaacgaaatcgaaggtaaaacaacatagctaaatttacctattttataaaaaaatattgctaaaagtaactaactaatctaccattagaggtgtgaatacatcggatttgtaggtactaattcaggaggtttcaaatgagtaatatccttatcagtcttttgacattgatagctattttattttgttggaaatcgctttatcaaaatccagctagacagatagctggacgaaaattttatattaccaaagaatatcctactacttatgctaatgctgtcgataacttagaccatgctactattcaatttaaaaaggatggtagtatcaagtatgaagtaattaatgattattccaatgataaatggacaatcaatggccacaaagttgaaatgggtaacattgctgatcccgatcgcacttatattgatctgaatgatgaacgtcaaattgacggccacaccttctatgaaataaaatttgaagatgatataaacattttccaatatttcctagtttcagagaactaatactttacaatttaattaaaactataaaaaacttcagaaagttagtctttctgaagttttttattttggtaatctattttgtttagtttctgacactaaatgtttaaaacaggatgcaaacttatcaaataatagaattgtaccataacataatctaaacttataaaaaaataataactgaaacccggggttatagggactcagtttaactcttagcaaaaagataactactagttaaacaccgcaatataagcaatctaacatgatttttaaaaattacttactataattaaaaactactttcttccaacaataatcaatacttagcaaacaattaaaagttattttgctatagaatcattagctataaatgtttatattctagtctaataacaaaaaaatccctaaattagattttagaaaaatccaatttagagattaaatctacgtaaaaactttttgtattggcaccaataaaaattgtaggaaaattgtagggaaccatatcaatttttattgttttccgtcccattaaacactcttaaaagcccgtagttatgcgtttcttattttaaattttatattacttttattcccattccacagttgccggtggcttagaagtaatgtcatagacgatgcggttaacatggtccacttcatttacgatacgtaccgaaatcttttgcaagacatcccatgggatacgagcaaagtcagcagtcataccatcaattgagttaacggcacggatacctactgtgtaatcgtaagtacggccatcacccataacaccaacactacggataccaggtaaaacagtaaagtattgccagatatcacggtcgagaccggccttcttgatttcttcgcgaagaatcaagtcactgtcacgcacgatttgaagtttgtcttcggtgatttcaccgattacacgaattcccaaaccaggacctgggaatggttgacgccaaacgagatcttctggcattcccaatttttcaccaagatcacgagcttcatctttaaataaagtacgaagtggttcaatcaattcaaagtgcatgtcttctggaagtccacccacattatgatgtgacttaatcgtttgagcagtatctgttccactttcgattacatcagtgtaaagcgtaccttgagctaggaagtcaattcctttaagtttttgtgcttcatcattaaatacttgaataaactcgttaccaataatcttacgtttttgttcaggttctgaaacaccagcaagcttactcaagaagcgatcttgagcgtccactttgataatgttcaaaccaaacttaccttctagactatccataacttgctttgcttcgcccttacggagtaaaccgtggtctacgaagatacatactaattggtcaccaattgctttattgagcaataccccaactacgctagaatccaccccaccagaaagaccaagcaatactttacggtctcccacagtttcacggatttgttgtacttgcatatcgataaagtcgttcatggaccagttagctttagcttcacaaacgtcaaatgcaaagtgccggagaatttcgttaccatattgagtattacgtacttcagcatggaattgaaccccgtagaacttacgagcatcatcagccattgaggcaatcggacagtttgcgctagttgcaacggtcttaaatccttcagggacttcacgaaccaaatcaccatggctcatccaaactgtttgtttagcaggaagctctttaaacataaccgcttgatcatcagtcacatcaatatcagcatgaccgtattcacggttatcagctggttcaactcgtccgcctaggttataagtcattaattgcattccgtagcaaatacctaaaattggaatacctaacttataaatttctgggtcaattcgaaaggcatctttatcataaacactgttaggtccaccagagaagataattcctttaggattaatctttttgatttcttcagcagtaatcttatgagaaagaagctcagagtaaataccgaattcacggattctacgtgtaatcaattggttgtattgactaccgaaatccaaaacaatgattttatcaaaatttgataaatctgcgttcgccaagtccttcacctcattcttttattcttactcatctatcatacagtaaaaacgggaaaaaccatagcccctaagcttgcctcacaatcgatgaaaaggctatcaatcgcgtcattatcttactacctaacgttttcaaaatttcattcttaacaaccgcattgcattaaaaataactactaagatacttatttcgtgaaaaagcatcccactggccatatttacccaaccataagccacaccgattaataacaacgccacggttccaatggcaattcctacgttttgcatcgtgtttcgcatagtagcctttgccacccgacgggcatttttgatattactaaaatcagaatcaatcaacaccacgtcggaagtttcaattgctacgtcagttccatttcccatcgcaatcccgacatttgccttggcaattgaaggactatcattgatgccatcgccgacaaataggacgtgcctaccatcattttgtaactgttccaaaaacagtgctttttcttctggtagcatttgtgctttaacctgattaatcccaatagtcttagcaatcttttccgcaataactgaattatcacccgttagcatccactgcttgtcgattccactctgttttaatttttcaaacgtctcttttacacctttacgaacctgatcgactaatcccaccatcaacaccagcttttgatcaatggtcatcaaaactacggattgtccatcattttcaatggcctgtaaatcgcgggattgttgagccgttagctcaatctgattttctgttaaaacacgacgactaccaatccaaatcgtttgcccttgatattcacttttaattccaattcctttaatcgttgttataggcaaattaaaatcggctgtagttttttgcccacgcttttcgtagtattccacaatcgaacgagctaagggatgattcgtttgtttttccaaatcggctgctaatgctagccagtgatcttcttgatattctttaatgcttttaacggtgggccgtccttcggtaactgtacccgtcttatcaaacaaaatcgtatccacttgggctagttgatcgattacgtctccacccttaatcaagattccagccttagctccacgcccgattccagctacattggaaactggcgctccaattactagtgcccctggacaagctagaaccaaaatcgtgatggctaaccgtaaatttttagtgaaaagtaaaattaatattgccactaccaaaacgaaaggtgtgtaatacttggcaaaacgatcaataaacttactcatcggtgcttgattatcctgggcttcttccactaattcgataatttttccgaaagttgtatcttcgccaactttttgagcttgcactaaaatctgaccgttttccacaatcgaacccatataagcttggtctccagtggttttatccactaatttagattcaccggtaattaacgcttcatcaacttcagcactaccgttaataattccaccatctactgggacctggtcgccaactcgcacaaccagaactgccccttcatcaacctcatcaatttcaacttcttgatactgaccatcaaccaccatggtggccgttgttggctgcatttccgttaaattttgaatcgcttggtgtgttttttgtagcgttcgctgttccaaaaaatttccaaaggcaaacaaaaatgttaccattgctgcttcttcaaattctaagatagctactgccccaactacggcaatactaactaataattcaatgctcatcactcgtgctcgcaaagcagaaatggctttgaatatgataggtagtccggctaccaaagttgctattccgtaagccccattggcaatcaacccctggtcagctaagtgttgcattaaccaaccaatcacggttagcgttccagctactaccagcatgggattggcatgttgtgtaaaccatcgctgtattttagccaaaattaatcatcatcctcttcgtcgtcatcttcttccaggccttccaagggttctttacctaaccgcgcttgaattgctgctgaaaattgattgaaactaccatctaactcaatcaaaaagttttgtaatggaaatttactttcattttgggctaaaataatggctcgactaataaacatcttgctggtttggatatcatcgactaacattgctaacatttcttgatccgttaaatatttattgcgcgcattttccgtcaacattttatattctgaaaattcttcagtaattgatgaaggcttttctcctgcatttactaactgatgtcctaattggttaaagtagttatccacagtttggcgcatcgagcttaaaaattgttgatccgcaaaataattgtttccttttatataccattctaattggtttaatttggtcgacatcacccgtagattcgccaagatgtgattagtcattgccccagctgtggggagatgatggtcaatttcattttgtttttgttcagcttgatatagctcttcaatttcttcacgcattagctttcactcacctttgtttttaagtctttaacggtatatcctaaattttcgaccgtttgtttcaaggcttcaccttttatttcaggttcgacttcggccttgattttactagcattgaaaaggacttttacccctttaacaccgtccatcttattcaaggccccttcaattttggtcatacaactaggacaagttaacgtgtccaatttcataataatttttgtcatttcaactaacctccttgatttgttatattaagcatataaggtttcaaactagttgaaattgacgtagatcaatttttttaaatttatttttagctattataaaagtaacctaatctagggaggtcatattttgactaaacaacttcatcagcatcactgtgttccactagtcccgatttttaaaaacttaaatatcgaacaaactgctgtagtggaatccatcgtgcatcatcagcaacttcctgccaattcggtcttatatcaagaaggaaatcgaattgacgcactctcaatcattgccaacggccaaattaaggtctttcgtactgccgaaaatggtaaagaacaactcttatatctcctccaagctggtgatatcaacggtgaagccgcgctctttaatcaaaccgaacataactcgacggctattacgctcactcccacaacggtttgtactattaatcgcgctgattttcaaaatttacttacgcgttatccccaggttggaatgaacgttatgaacacattaggtagccgacttttagaattagagcgtcaaacgactaaatctaatacggaatccgtagcaagtcgtctggccgactacttagtcgagaccgcatctgctttaaatcaaaatccggttcgtttaccccttaaaaacaaagacttagcgaccctcctcggcactacacctgaaaccattagtcgttacttcaagcaatggcacgagcagcatttaattactaaactagaacgccaccaaatcaagcttaatgatgtggataatttacttttagctaccagtaactaaataacctataataaaaaagattgcctagtgaggaatagctcactaggcaatctttttaaactcgtactaaaatgttatccattacatgtcccgtagtcttatgcagaataatatccgctctaaaccgcgtcggtaagataaattcttctaggttttttaaattaatgtctcgccaaattttatgtgccatttcgaaagcttccgaacgcggtaatttagcgtatttgtaataataattagttggatcatggaacgctgtatcaagcaataccccgaagcgttctaaaaaccattgctcaattaaatttgcatccgcatccacataaatggaccaatcaaaaaaatcactcacataaatggtttcattagccggtaactgtagcacgttgatcccctcaacaatcagaatatctggttgatcaatcgtatcaaactcattttccacaatatcgtaaacttgatgagaatacttcggtactttaatttcttttttgccactcttaacgtcgcttaaaaacttaattaaggatttcatatcatagctttcgggaaatcctttgcgatttaaaatattccgtcgcttaagttccgcggtagggtataaaaatccatcggtagttattaactgggtttttaagctcgtaaaccagctactcaagagttcttgtagtaaacgtgctgttgtacttttaccaaccgccacactccctgaaataccgataataaaaggcgtttttttaactggcaattgtaaaaagtctaatttatcgcgattccatttttcaaaatccgcatactttttttggagcaatcgtactaacggcacgtaaacatcttgcacatcttcgagtgaaatttgatcatttaaagctttgatatctgttaattgttgcgtcgtcagtggtaattcggctcgtttggctaaattttgccaatcttcccgcttaaactcaaaataaccttgtgcttccatttccaattcctcatcttcaaaaaattacgtctattctagcatagataattcgtttattcagactcagaaattgattgttgaattttttccgcgtcactagcctcatgtgccataaattctgcgtcttgaattggtaaattgaggtctaaaccgtctaatagttgccaagaaagtttaacttgatccgccttaaagtctagtaaatgacctccgaattcgtgttgatcgtcaataaaatgaagatgcatccccgctactcccgcaccatggaaaagatctggggtgtagtagccaactactgttcctctaacatcttcagcattaaaaacttgttgtttagatgctgtttcactaagggttggataaggacgttcttgtttctttaccacccgagtttgaactgtacggaaagttccactaattttaatagcaacaaatgtattttgatatgacaattctttagcaagtgtcgcatccacatctttcatctcaatgtcagataacactgctcgtccttcaaaatccgctgaattaacgttagcaaacggtaatagttcatcatcaccaataaccctaattgtaccatctgctagcgcttggtaagggactccatctaaaataattaattcgccattaaggccttcagcagttccgattccaaagtcaccgtgcttcagtaaatcggaaaccgcaagcgtcccaccaaaaagtccatctactagcattgcgagcgtcccatgttgaaataattttgccatttaaatccctcctataattggtcaggaagaagtgattgccctagcttaacgttatcagaataatcaactgggatatccaccactactggtccttctgtttgaaatgcttcgtcaagaattttacccaagtcctctggtttttccacacgcaatcctttagcgccatatccctcagccaatttaacaaaatctacggggccaaagtcaacgcctgcagaatgtccatacttaatttcttcttgaaacttaaccatatcgtagtatccatcgttccaaataatatgaacaatatctaacttttcacggacagccgtttctaattcttgcgcagagaaaaggaatccaccatctcctgaaactgaaactgacttactattagggcgtaacaaagcggccgaaatggcccatggcaatgctactcctaaggtttgcatcccattactaaatagcaaatgacgaggttggtaacttctgaagtgacgagccatccaaatgtagaaacttcccacatcaacggagacagtcatttcatcatcaacccgatattgaagtgcagaaataatagacaatggatgaatacgtttggaatcttgcttcggtactggtggcaagtcttgcttgttttgcaactcacggagtgtttccaagtattgttcaccatccacaccaacttggtaatctttaagatgcggagttagcaaatcaatcgtttgcgcgatgtccccaactaattccttttcaggttcaaagttatgatcaatttcagacggcgaatcatcaatgacaataatcttgccatccccttctgcgttccagttacgaggttcatattcgatggcatcgtaacccactgtgattactaaatcactatgcttcaataacttatccccaggttgattgcggaataaccccactcgaccgtaaaaatgatcttctaagtcatgagaaataataccagcaccttggaaggtttccacaacaggtaagttagcaatccgtactaattcgcggacggcttttgtcacctcgggagacgaggcccgcatcccgagtagcaatacgggaagttgagcgtttcgaatggctttagctagctcttcaatttcaatcgggctcgccggtccgagaatcggttttcttaaaggtttgattggacgcgaactaaccggtgcattaaccacatcttgtggaaaactgacaaaactagctccctgcttagatgattcagccgcccggtaagcatttgctaaaacttcggaaatgttttctggttcttgaacttccacactaaacttagtgatgggttcaaataaagcagcgttccgcatactttgatgagttaaacgcaataagtcattccgtggtacttggcccccaatggctaatactggatcaccttcagccgtagccgttagtaatcccgttgcaaggtttcccacgccaggtcctgaagtagtgagcactactcccggtttaccggtaattcttccaacaccagccgccataaatgccgcattttgttcatgtcttgtaataattaatttaggtttttttgctcggttagaatgttccagttgttcaaataacaaatcaattttggctccaggaataccaaaaatatatggtacatcatggttgattaaactatcgagaattgaatctgacccggtataactactttgaatcattattttttctcctttggtttttgaaagtgattacatagttaactatatcaaaatataataaaaagagcttaataaaaaagtatcttattttaagctctttgtgttgtattttaagttattaagcttttttaatatataaattttcaggaatcttagtaattaacggactaagatcattctcagcaacgattaagagtcgatgcattgcccgtgaacaaattgtatataataactgttcatcccgattagtttgataaatcttcgctgaggtattccacacgattactgaatcaaattccaatcccttggctaagaaagatggaacaacgatggtaccttccaccaaacgctgattttcagttcggattagcgttacttgctcgccagctgcttttaattcatccgcgatttgttcacattcagcatagctccgcccaataatggcgctagtctcatgatcttggcgatcgcgatgaagctgttcgatcaccgcctcaaccattccttgatgactactattaattgaaaccgttggtaattcacccgcacgattaaaggattcaattgcttcacctttaaccaagatttccttagtaaagtctgtaatttgttgtgttgaacgatatgacttagatagttgaactacttccgtcttttctggatcaaacattgttgataactctgctaataaagtatcactagtttcattggcgtaaattgattgatttaaatctcctaaaagtgtgaattttgctcgaggaaaattgaaccgaatataagctagttggaaagcattataatcttggatttcatcaataaatgcataacgcatggaacgatcaccttttttacccgtaattaaatcatacaagtataaataagcggttgtatctaccatggttaattgatgctccttaagcccgttcaccactttatccacatggttatcccattctgcttctgttaccccaactttctttaaatcgtaccatttggggaacgaacgtagcatttggacatattgggcattaatacttaagaagcgattacgcataatcgcatttcgaaccggtttaagttctttcattacgatttgacgagcaaggaatttaaattcttcatcattatccttaaattcacggggctcgtttttaaataggttgtgtaattcttcttggctaaggttttggaccgcttcttccacccacttagttctcaattcactacctactttttggttcaattggcggatcaaggcttcccgagttccttcaattcggttacccaaattataggtagtattaaatgaatagtagatgtctttaattttttccttagtagcaaacggttgaccttggaacatgatattgcgaaatcgcatacctgccgtcccaagatatttcgcatatttagtagtagctttgaaaaattgcaagcttcctttgaattgttcgattttacgttccgcatccgtgagcttcttatcaaaacgttgttgcaagttttcaacgtcgatgtttggaatccgtcgtctagtaaattgataataggtcatctgaatcatgttttgttcgcccagttcgggtaaaacttgatcaacataatcattaaacaattgattaggtgaaaacatgatgacttgtccagcatttaaattaccgcggtaacggtaaagcaagaaagcgacccgctgtaaaatcgcagcggtctttcccgatccagctgcaccttgaacgaatagtaaatcggctgcggtatttcgaataattttattctgttctctttggatggttgaaacaatacttttcatcttaacatcggattgagaacccaacgcgtttagtagcatttgatctccgatagtttcgtccgtatcataaactgaaatcaatttaccatcttcaatagtaaattgccgttttaacttcaagtctaccgtttgcgtgccatctggcgttgcatattccacatcgcccatttttccgtcatagtaaacactggaaatgggagcccgccaatcataaatcaaaaaatgatcggccgtgtccgaaaatgaagctaaaccaatatagatggtttcatccttcttttcacctttttcgtgaaaatcaattcgtgcaaaatagggccgctttttcatttctttaaacgtggttaaacgtttattagcgtgttgccaactattttcgcgttcagataataattgctgttgttgacggattgaaattgcagtatccatcatacctgaataactggaagtgttaattcgaacatcgttgtaaaaattcttatcaatcgcactacgatctttttcggcattatcggcgtcgttttctgctttggcaattgcagtatccaccttatctaaaacttcatctaaatgtctattttcgtattcaaaaattccctctgccaatgtgaatcacctctcagttttgttagacataaattttactcctttttatgcgttttcacaaagatttagctaatttggtacacgggatatatgatagaatgatttaggttttacaaaaaataagtgaggaaaggatttttatgaaaaaattaaaactatattttgttcgtcacggacaaactattttcaacaaatataaccgaatgcaaggttggtcagactccccgttaaccgaaaagggctatgctgatgcacatcgggccggagctcgtttgaaaaacattgcgtttgatgcggcttatgcctccgatactacccgcgcaatgaataccgccaacgccattatggctgaaaatgcgcatgaacaattaccaatcgaaactatgccagaattccgcgaagaattctacggctattacgaaggtagtgattctgcccaagcttggttcgaagctttaatgccagtttcaggtaaacgaactttccatgaatttttggaagaaaacccgattgctgcttcaaaagatgcgatgaaagcagccgaccctttccatgatgcggaaaatgatgcagaattctgggatcgtctcaatcgtggctttgcccaattgatggaaacccataacgatggagacaccattttagtggtcagtcatggaactacaattcgttcaatggcaggaaaagctgatccaacactagatattacttggggtcctcaaaatggtagtattaatcgttttactttagacgaagatggccttcatctcgatgaatacaacaatcatggagacgaagagcttttgtaaacaaattttaggagagataaaagaatggataattcacctttagattcaaaaaaaaggtatattagttggcctgtagtagccttaatggactttgtaacggttattgggttcgacgatttaatttataattttcacaatcaaggtttagcaattgtttcaacttggattttaatgattttactttttgtttggccctatgaaatgatggttggacaattaggtggaactttcaacgaagatgggggtggtttagcatcctggattcgttctaccaatggagatttagccggatacatcgtggctttcttctactggattgctggtttaccatacgtagtcgatgttgctaattcggtagttgtatcaattagttggttagtcaaaggcaatggtgatttacaaaaatacatgccaaccatcatgtttgctatttttactgccgtcgtcttcttagtatttatttggttccaacacttcttcaaaaaccgttcacttgaaattctaagtaccattggtggcggtgcgatgttcgtgatgaccatcctatttgtaattatgaccgtagtggctttaatgcacggtcgtcatattgcgactcaaccatttaatttaaaagcatttattcctaagattgatggtcatttcttatcaacatttggtttgttaatctttgctatcaacggcgctgaactagccgcaccatacgttaaagaaatgaaagatggaaaacgcgattttcctaaagctatgatgatgctcctcttgatgaccgtcttcttaaccgtctttggatcattctcattagcagtgttcttcaatgcccatcatttaccatatgatttgaagatgaatggctcttactatgctttccaagcactgggtgatgaattcggaattggaaatacattcatgtacatcttcgctgtcagtcaagcagtttatatgtttgctcaattggccgtaattttagatgcaagtacccgaatcttcctttcagatgtagctatgaagtatcttcctaaatcactaggtaagttaaacagtgatggattaccaattaatggttactggttaactactggaattgtttcactagtgcttttccttagtaactggctcccaagtattaatgatatgtttaactggttacttaatattaatgggattgtttccccattcgttactagttttgttttctttgcctttatgcgaattcggcaaaatagtaaggattttccatcacaatatgttttcatcaaaaatgatattgtagcttggttagttggagcttggtgtttcgttattaccatcgtcttctcgttcttaggaattcgtcctactgacgcaactcctggtactaacttatacgataaagaacttgcacttaatattattattccaattatttttattgcactctcagcgctactaccatttatggcttgggtagaacggaatgaattaaagaaagtttctcgttcttcttacccatttgcgattgtcacctttgccatcggtgcttacttcaccattaaaggtgggtacaatgcccaaatttggtcaggcgtctttgcttggggaatcgtagtcgttattacaattgctgtttatgcactgttctttaatatctttaaaaaagcatttaagaaagcataggagttacatgaaaaccgtcaattattatttcgtccgccatggacaaactttatttaatcgttatcgtcatcttcaaggttggtcagactcaccactaactgaaaaaggcgttgcagatgctaagcatgctggtgatttgcttactgatgttaactttgcaaatatctattgctcagatactacccgagcgattaagactgctcgttacatcaatgcccaaaaccaacatcctaaaaatgaaaaagaaattgagatgatttcagcttttcgcgaacaattttttggttacttcgaaggagctaactcagtcgaaacagagtttaaattgtatcaacaacactccacggttgaaccaaccttaaatgctatgacggctatgcatggtatcaaggtcgctattgatatctggaaggacgttgatccttttcatgatgctgaaagctatgatgaaattgtcactcggctaaagcaaggattggattatacctttaaaaaagctcaagatggtgatcatctgctggtggtctcccatggaaccttgattcgcattttaacatccatgtttaacgatcaaatcgatgtttctcacagtcctcgtaacggaagtgttacggaacttcagttaactgaaaatagtggacaaattaaatactttggtaaaactactaaaatataaaaaagaggcttgacgtaaaaacgtcaagcttctttttatactcactttattttataagcttctgctcgttggcgatattcttcaatctcatcatcggctgctttgacaaaatgattaggtgtaatttcaaccatgcgtcgttctttatcatcaaattcacgggctgcatcatatggaacctgacgacggttacgttcaaactctggatcaggttctggaacagctgaaactaaactagctgtgtaggcatgcaaaggatgattataaacttcctctgctggaccaatttctagcatcttaccataatgcataactccaattcgatcgctgatatactttaccatggataaatcatgagcaatgaataggtaagtcagtcccttttcttcttgcaactttttcattagattaaccacttgagcttggatggaaacatccaaagcagaaattggctcatccgcaatgatgaatttaggttgcaccgctaacgcacgggcaatcccaatccgctgacgttgcccaccagaaaattcatttggataacggctggaatggtctttatttagccccaccgtttccaacaattcttccacttgttcagaacgatcctgtttatttttagccaaatgatggatatcaatcccttcagcaataatatctttgatcttcattcgtggattcaaagaagcgtacggatcttggaagatcatctgcatttcgcgtcgaaattccataatgtctgaccgcttcttgatcgaagcaatatcttttccttcaaaattcacattaccagaagttggatcctgaagccgaataatagcccgtccggtagtcgtttttcctgaaccagactcacccactaaaccaaaagtttcaccttcgtagatatcaaaggaaacgtcatcaacggcatggacttcgtcttttttaccgacattaaaatattgttttaaatgctttacttctaaaatctttttagttgtgtccactatggtttcctcctattccccaacgcgaaggtcggccggatcaatttgaaacgtatcttgataaatcttccaacgccgttgaatttctgctggtggttccactgcaggtgcatctgggtgtaataaccaagttgctgcataatgcgatggactaaccttaaagaatggtggttcaagttcctcgtcaatcttcatcgcataaggattacgagctgcaaaagcatccccaactggtggatccaataaatctggtggagtaccaggaataggctctaactcgcccttagctgtatccaaagtaggcatggaattcaagagtccccaagtatatggatgctgtggattataaaagatttcatccactgatccatattccacaatctttccggcatacattaccgctactcggtcggccatgctggctacaacacctaggtcatgggtgataaaaataattgaagtcgaaatcttggcttgcaattctttcattaaatctaagatctgagcttgaatagtcacatccaaagccgtagttggttcgtcagcaatcaaaatttctggattacaaattaatgcaatcgcaattacgattcgttggcgcatcccccctgagaattgatgtgggtaatcattaattcgtttttctgcgtctttaatgcccactaacttgagcatttcaagtgctcttttttgcgccttttctttactaatcttctggtgaatcattaatggctcggcaacttgtcgtccaatcttcatcgttggatctaatgacgtcattggatcttggaagatttcagcaatatttttaccacgaacgtcttgcaattctcgatcattcatctttaaaatatttttgccgtgtagctcaacggttcccccaataacttccgcattattagctaacaatcccataatcgttttagtagttaccgtttttccagaaccggattctcccacgatggccaaggtttctccctgatgtaaatcaaaactaacgtctcggattgctttaaccgttccagcataggtatggaaatcaatcgctaaattttttacttcaagtacttttttatttgaactcattaatcaatttcctcctatctacgggctgtccgtggatcaaaagcgtcacggagtccatcagctaaaatattaaatgcaatcatgataatggccaaaacaattgccggataccacatttggaatggtaagaactggaaattacgttgcccatcattaatcaacgttcctagtgatgcagtaggagcttgaataccaattccgatataactcaagaaggcttcgaagaaaattgccgttggaatggtaaacatagtttgaataatgatgacactggataagttaggcaacaaatgcttaaccgagattttccatggcgattcacctagcgactgggcagctaaaatgtactcttgatttttcaaacttagagtctgggctcgagttagtcgtgccattgtagtccattcattaatcgcaatcgctaatacaatcggtaaaatcccaccatttttgaaaaccaatagtagcagaaccataattacaatattaggaacggaagacataatttcgataattcgctgcatgaaaatatcgatttttccgcctttccaggccgagaagatcccgtaccctaccccaattagtaaatcaatgatggttgcgaaaaccccaatcaatagagaaatcatcgtcccatgtaaaattcgctgtgctaagctacgtcctaaataatctgttccaaggtagaaatacttatctgaaggaactttattagctttataagcatcaattcgttccccaccttgcacaattgttccattaaagccgttaatgttaactcctggaaccttagccggtaagttagcataatcgggattagaattattgggatgtggagcagtgatgggtgatgtgaatgcaaaaatcgcaacgataattaaaatccacatactgataaaggctgctttattttcctttaaacgccgccaagcgtcttgcaaaaacgttctcgacggggcagtaattttttcatcatctaaacgttcacccttactaactggttgaaaggcatctttaggtaagttcactttttcttccattacattactccccctttccagtaattctaattcgtggatcaatcaatccatagatgatatctgttaataatagaactaaacataatagaccagagtacaacatggttacacccataatagttggatagtcgttagttaagattgacttaacgaattgttccccaattcctggaattgagaaaatattttccacaaccattgaaccagtcataatagcgacggctaatggacccactacggtaactaatggaatcaaactattacgcaaagcatgatggaaaactattcccattttgctcatccctttcgctctagcaagttcaatatagtcacttcctaagacatctaccatttcggttctcacaaaacgagaagtggttgcaaagggattagctgccaaagcaattgatggaaggactgtactggcaaacccaccccatccggctactggaagccattgtaatttaagtccgatgtagtattggagcacaatcgccaaaacaaaacttggtacagaaagtcctagaatcgaaataatattagcagttccatcaacccaagtatttttgcgaatggcactaattgatccagtaatggttccaaaaaccacacctagaatcattccctgaatcccgatggttgcagaaggtccaattcgactaccaattaagtaagaaacctcttgattactaaattggaatgaagttccgaaatctccatgcactgcgttaatcatgtagctcaagtattgttgccacaccggcttattaagcccatattgttcataaataatctgaatttgcgcttttgttaactttgcttgattattcaatggtgtaccaggcattaacttcattaaaaagaacgtaatgctggcaatcaagaacagggtcagtagcaagtaaaaaacacgtcttgcaagatatcttgccataaatctccctcacaatctctggtccaatatgcacaaagggtaagagcaatgtatcactctcacccaatgtaatttgttcccatttttaattatttgatatatgcctgcttgtaatcaaagttcaatccagccgagttatacacaatacccttaaggttggttttacgcaacattgattgtccttgttgataaagtggagcaactgcttgatccttcaataggatttgttccgccttcaacatatcatcccaacgtttttcagtattaccagcgtcagtagtattcgcagcctcaatcaacttatcgtattccttattagcccatttaccgttattttgtgagttatcagacgtaaatagttgaaggaatgagattggatctgagaaatcagcgctccatgctgtaataactgcatcgaatttaccatcgaccgagtttgctaaacggttcttaaatggcacgttacttaacgaaactttcacattaggtatcttttcaaatgctgattgtaagaattcagttgactgcttagcagcggtagtatcatcactaagaagttggaagttcaatgaacgcataccttcttctttaagaccttcagccatcaactttttagcttctttcaaattgtattccgaagctgatttaacatcgacttcagaagcaaagtccttgccattcttttcatccttagccaacttagccggcgttactcccgttgcaaccgttgatccatcacctttaatcttatcaacaaattgttgacgattaatagctaacgaaagagccttacggattttagcattcttaaagtacttgtccttcttttggttatattcaatgtagaaagttgaagcatttaagtacttaacgtagtctttattattcttgtattgtttaacctgttcactagataaggtcatttgatcaagcttattactattatacatgttcagagccgttccagtgtctttaaccactttccagttcaaagtatccatcttgacatttttcttatcccagtaagtcttgttcttaacgagcttccagcttaagttagaacctgtccaaccttccattcgatatggaccgttataaactgttgttttagccgaagtaccatacttatcaccgtactttttaacggccttctcattttgagggaagaaggttggcattcccatcaggagtttaaagtaagaaatcggacgatcaagggtcaccgtcaacttatacttgccatcagccttaattcccaatgatttatagttcgctttaccactagcaattttatcggcatttttaacacccgagaagatatatgcgtattgggaagctgttttcggatttaccgttctttgccaaccatatacgaagtcttttgcagttacctcatcgccattactccacttaaccccttttcgtagagtaaatgtgtaagttttgtgatcatctgaaactttagtttttgtagcaatcgcattttcaactttattgttcttaccaattcgatatagtccttcttctgtactacctaattgggtaaaaccaaccacatctgtaaccttagattgatccattgttgctaattcagcagactcttgaatgtttgctgtttttttactatttgaattgctcgaaccacatgctgccaaaataaacgttgaagctaatgcaactgagccgagctttacaactgtttttagtttcatctcacacactccctatattttcaaccaattatcttttactatgaaaataagtatatattaaaattatattaaaatcaatattaaactctaattattttaactattctctaatccaaagcaccatgttatctcataaacgttaattacatgtaactaatcagcttccatgatataattatctaaacgttttcaaactttggaggccatttattttatgaatgagaaaatactaatagcgggactcgaactccccaatatgaacctggattatgccatggatgaattaaggtcgctagccatggccaacaatatggacgtggttgatcaagtgactcaaaaattagagcgtcctaatgccgccacttactttggtaaaggtaaagttgaggatctggttcaaattgcaacggccttagaggtggataccattgttttaaacgatgaactttctcccagccagttaactaatcttgaaaaagaaactaatctacattttattgaccgtacaggattaattctagaaatctttgctaatcgagctcactctcgtgaagctaaacttcaagttgaattagctaaacttcaataccaactacctcgattacgtactagttccacccaacgcttggatcagcaaactgctggtaatacaggaggcggcttcaccaaccgtggttccggtgaaactaaactggagttaaaccgacggacaatccgtaataaaattaatcatattaataaagaactaaaggaaatgacaacctcttctgacattcaacgtaagcaacgcgataagaaagacattccaagtgttgcattggtcggttacaccaatactggtaaatcaactaccatgaacgggttagttcgtatgtatggtcgcaatgaagacaaacaggtttttgaaaaagacatgctcttcgctactttggatacgagcgtgcgtaagttaacgttccccgatcaaaaagaattagttttgagtgataccgtcgggttcgttagccatttgcctcatcaattagtcaaagctttccgttcgactttggcggaagctgctaaagctgatttactagttcaaattgttgatatttctgacccccactatcgtgaaatgatgcaaactacagaagataccttaaacgaaatcggtgtaaccgatattcctatgatttacgcctttaataaagccgatttagctggagttagttatcccactctagatggcaatgaattaacttattcagctaaacaacttcaatcactagaaatggttaccgctttaattaaaaaacaagtcttcaaaaattatgttgaagctaagttcttaattccttttaacgagggacaggtggtcgattttcttaacggcaacgctgatgtaaaaaagaccgattataccgaagaaggaaccgaaattaccgcagaattaaaagaaaaagattatcaacgccttgctcgttatgtaatccaataattaaagtaaaaacagacgctcaattatggacgtctgtttttttactcctcttgaccttcgggttaccctaaggtttatactctatgaatgaggtgatggcatgccagaaaaattagtaactatctcaaccttagcacgtttgttaaaaacaacaaatcatactattcgttattatgaagatgagggcttatttaagcccgctgaaattgcaccaaatggctatcgaaaatacggtatgtcacaagcataccaactatcctttattctttttttaagacaattggatttttcagtggcatctataaagcaaatcttgcaaaccaacccatccgtaacggatttactgttagctaaaaaaatagccattcagaccgaacggcatcggttggagcagctagagaaaatattagatgatcagttaaatatccatcaaaattcagcgagtcctaccctaaaagttgcaacaccattttatcttcaatcggtcaaacgcttacccatcgattatgattttggaataaccgaaattatggatgggaattggaatcctgactttatattgcgcaaattgtattacgtaattactcctgactactacgatatttgcatagtatcaactaaacctacgtctcaaaaaatagcacctggtgagtatcaactaactcccattaaagcttccagtgcagaatcatttgaccagcaagttgcaccatacttaaaaaatcaaaaaagaattattgctttagaagatcgccgaggatttttaacagccaatagtaatctagtaattcatcttctcatccaaaagacataaaaattataggaggaaaagaaaaacaatgccgatttcaaccaaaagactttatttacgtccttttacaccagatgatgctcccagcatctatcaatatgctaaaaatcctaaaattggacccattgctggctggcccgtccataccagcgtcgctaatagccgacaactgattgaacaatatttgatgcaagctactatttatgccgtaactctaagggacaatcccgacgaggcaattggtagcgtcgggctagaaatagttaataaaggtggtgggaaatctttcatgggagctaatgatgccgaaattggttattggattggagagccattctggggtcaagggctaatcccagaagctgcagcagcggtcatcaaggatggcttcaccacgttaggattatctaacatttggtgtggttactatgatggcaatcaccaatctaagcgagttcaaatgaaactaggtttcaaacctgaactaaccatcgatgaaatgtataacccgatcttagacgacatccgcaaagaacacttcacaaaacttaagcgaactgagtggctccgtcaaaatgatcagtaaacacaatgttaaaaaataggacgagtaaccttagatgaggttactcgtcctatttgtataattttatgatgcaattcttttttccaagtaacgcgaaaatagtgataacgcataacaaacaataaagtacattacagccaatgcaacgaacattgggatgatgtaattagtattttgtccataaatgatttgcgcatgatacatcaattctggcagcataataatcgttgctaatgaagtatccttaatcaaagaaataaattgactaactaatgccggaatcattcgtacttgagcttgcggcaaaataatgtaacgcattgcttgccagtacgttaacccgttagctcgagcaccttccatttgccctttagaaattgactcgattcctccacgaataatttcagctagcatcgccgattcaaaaacggttagagctaggatagatgaaggaataatttcaattctcaaacctaagttaggtaaaccgaaataaacaaagaagaaaattaaaatcaacggtaaattacggatcaaatcaatgatgaaacccacaatcgctgaaaaatactttattctcatataccgaataaatcctaatattccacctagaatataacttaggataattgagataaccgaaacttcaacggttatccaaagcccctttaataaaaacattaaatttactgctgagtaagcatccataaatgatttcatcatgcagcacctcgattcgtccgtttttcaagataacgcatatagtaactgagtggcatagttataattaagtacataactcccactactaaatacgaattaatcgtatcaaaggaagtagaagcaatatcatttcctacatacatcaagtcaaagccggctacgaaagcaagtactgatgaattcttaaccaaattaataaattggttacctagaggtggaatcacaatcttaaaggcttgaggtaacacgatgtaacgcattgcttgccaataagtcattccgtttgagcgagctgcttccatttgcccaccactaactgattgaattcccgctcggacggtttcagcaataaaggctgatgtataaatggttaatccaatcgttccagcaacaaatccattaatcgaagcgacatattgaggaattacgatgtagaaaaacatcgttactactagtaacggaatgtttcttaccacttctacatagattctaccgatggtgtgtaatactttacttggtaaaacttcaaaaatcgcaaacattgatccgatgatcaaactaaagaatagtgcaatcacactacaaaggacggtttgtcccagtccacttagaagttctgagccatgactagcaattatattaatcatctttcaacctccttgtagtcaaatccagcgatatttccaaaccatttttcgactagtttgttgtactcgccactttcttccaattctttcaaggcttggttgagatgctttttcaactgaccttgtcctttattaattgcaatcccataaggttctttagtaaaggcttttccaacaacttgataattaggattgtcgaccgccatcccaaataaaataccattatcagtcgttaacgctgctccttgaccagattttaaagcggtcaaagcctgagcataatcttgaagctgaattacctgcgccttaggagcaaactttttaatattctcgacggaattagatccaaccaccccgattactttagttccgggcttattcaaatctttaacgctcttaatggagctaccttttttaactaaaagcgattgaccagcatcaaagtatgaatttgaaaaatcgacaactttttcacgttctttcgtgattgtcatcgtagcaataattgcatctaaattaccgtttttcagtaaaggtatccgagtttgactcgtaacttggataaagttggctttggccttttttccgagcatttgcttggttaacgctttggcaatatcgatatcaaatcccttaatttgtgaatctttaacatccatcaaaccaaacagtttagtatcggctttaacaccccaagtgatggaatccgtcttttgggcttgatcccaagcatctatattttttacttcacccttcgcaccacaactacttaacaacactaaacttgccatgagggtgaaaatgagggcgacacttttcagtatttttcgcatattctcccctcctaatgtttaataattttacttaagaattggcgtgctcgttcattacttggttgtccatcaaagaattccttagcttgatcgtcttctagaatttgtccttcgtccatgaaaataacgcggtcccctacttcgcgggcaaagcccatctcatgggttaccacaaccatggtcatcgaagaatctttagcaatctttttcattacatttaaaacatcgtcaatcatttctggatccaaagctgatgttggttcatcaaataaaatacactttggatgcatagccaaactccgagctattgcaattcgttgcttttgaccaccagaaagcatcgatggcatactttctgccttatctgctagcccaactaagtctaacaattccatggcaacttttttattttcatcatccttccgtcctagaactacacgaggagctaacatgatattttcaagcacacttttattgttgtataaattaaaatgttggaaaaccatgcctacttcacgacgaatcttattcatattggtcttcttgctagccaaatcaaacccgttaactaccagttgtccgctattaatactttccaatccgttaatagttcggattaaagtacttttaccagaaccagatggtccaatcaaaactactgtctcacccttttcaatcgttaagttgatatctgtcagggcgtggaacttcccatagtacttttcaacattatgaaattcgatcattgacataataaatccctccagctgcgcccatcggttatttaaacgaatccttatacaacctataagctcccattttttctatacctatttaaaatataagcgacaaaaaaaggactgtcaaagcatatcgcttgaacagtccttaattattttatactttaaacctcatgaagcgaggtattacggcgtttataggcaatattcacttttataaaaaaattttcattttcagtgataatccctgagcgtcctatcattttcttctcaccgccacttaataatacatccgccaagtaaaggtgattttcttgtttagcagcttcgaaactagctgccccaactttggtaattacgccaactggtaactcttccatctgatttaatccagcataaatggtaggctgcccattaatcatttttatgtcagcaaatgggaattgaatgccttcgtccccaatagcgtaaacttccgtttgtcctggttgtaattgttccttaatctgttcatcacttcgtccaccgtaatcctcaaaaaggattccagcatttttcatcaacatcgcaatttgttcaatatttcgcttttgttcgcccgtggattcgacctgtgcaggtagtagcatccgttggtcaaacatccctgctggtgaactgctagcttgacgactttggcgttccacttgggctaagcgccgtctaaattcttctttttctcgaatttcttccggagcaccacccacatatttctccaagataggagaaatatcaaaaggtgctttcttagtcgtgaagaagtagtaaatattcataattgaaaaatacaagaacactaaaaagattgctaatagcaataatcctctaagatagcgtccattttgtaagaaacgaataccaatatatagtaaataccaatttccgacgaatgccatgaccgtgtaaacttgattctttagtttactcttaacattgatcattcccatataatggctcgctaatgtaagaaatgaaatcacgttaattccccctattgtgtgctagtcgccgagctacctgatgcagcttgggcattctgagttgtggtacctgccgaactttgtgctgcactagatgcttgatttgtatccgtgtcagcatcactagatgcattattagtagtatcgtcattattattttcatttgtatttgtgctagttttaccactgcttgccgtagcatctgatgagctttccgcatcactttgtgagtcttcggtgctatttgaatccattgtctcatcttctttggaactacttgtttcatcatctttagagctactatcttcatccatggaacttttacttgatttatcatcagatgaatttttatcgtctaaattactactactttcattattcattacttttgaagaacgcacgggcgctccttcagaagtgttggtcgccttattaacgattacgtttgtagcacttaaagcaatgaccatggtaacaatcgcaattggtgttaaaaaaggtggtgtcctatatgccatttctctttccctccgtctttaaaaaaagcatatcaaaaatatttagcttttatttcaaatattgattaagtttgcaataacttaaaaaaatcatctacttttcacccattaattgcttacaatctgcgcataacccatataactcaaaatgatgtcccgtaatctcagcccctggcaattgctcactaaagaagcttagagggcacatttggagttcccgtactttgccacagttattacaaataaaatggtgatgatgagtgtgccgttcattacaatctaactttacttcggttttaccatcattttcattttgattttcttcaacaatcccaatttcagaaaattccttaatgtttcgataaattgtattgtagctcattttaggatactcttggcgcattaactgatctaactccgtcaattccatgtagcggtcctcatggatagctagaatattgagtaagctctggcgttgtttagttaatttatagttattagcttttaaaatttttaccgcaatttctttactagttttgttcaaaaatctgcacctctaaatagtaatcattacgttttaccctaccataattaaccttcatttggtatctttttggttgcttctttaactctttgataaaattgatcaattttttgtttggtgtgctcccaatcatcgttattaatgaccgtcgcccgcccttgaagctcttctggcaactgcatgtcgcgtcgatattcgggactgtcaattcttttttggattgcctctaagctatcaccacgttttaacaatcgatccttcaaagttttttcttcgtttacccgtaaaaataagatttccacctgtgcccctaactctttaaggtaagttattgctccagctgtgtctaatacaatactagcaattgaattttttgaccaagcacgtcgaaggccctcatacgaagaaccatatcgatagtaagaatactgcacctgttctaagtaatggttatcatcaaatgtctcgtctgtttcaaagtaataatcgattcctgattgctcattttttctttttggtctcgtagtgtgggtaattaccttaatcactccatatttttggtaaaggtaatcggcaatcgtcgtttttcccgatccagttggtccagcaatcacaataactttatccatttttaactcctcaattcaaaatagttgcattttttccaaaaatattgtaaattaaagtatcctaacaaatgaaagcgcttttcaaagctttctaaaatacactttaaggataggaggtttatcattatgcaattcaaaaaatatagctcagcatggtatagtatcgctcttgatacagaaaagcaggtatttatcgctaatgataaagcccaaccagagtttcatgcaactggcgtaaccattgaagaggctgttcgcaatcttcaaagcctagaagataattcattcagcaagctagcataatttaaactctataataagctttatcaaatgaggataagagggctgtgacacttaaatgtgtcgcagccctttttctgtacttatttacaatttttattttacctatacgcttggttttatgctcgcaatgaaatgatcagccttatctaaggcttgtttcaagtttaaatacgataatttttcacgcgccgtaatgtaatcgaaccatccagctgaactaatttccgcttcttgtaaccgtaatgtcgtatctaaaggaacttcagcactaaataatgtaaccttttttaggtttttaccaacctggtaacttaatacctcgaaaaaattatcgttaactttcgtgataatacctgtctcttcgcgaatttcacgttgagctgcttcaatcacagactctttatcttcgacatgacccttggggaaaccccaaaaaccactcgttgcactttctaaaagcaagtaatacggctgattgttacgtaactgatacactactgctccaccatcaagttctaacgccatcttaaaacctccacattatcttccatataaattataccagtcccgttcttttaatttaatcaaatttacatttttaataaaagaaatccgattgacgtagtgaaactgattcagtattattagaaagatattagaaaaggaagtgtgttatgaaaataatagataaaattttgagaaaagaatcattagataattacttaaagactgactcaaaattcgaaaaaaccattggtccaaaagacttactggcgctcggaattggtgcagtaattggaactggaattttcatccttcctggtaccgttgcagcactgaaggctggaccatcgattacaatttctttcgtgattgctgcaattgtatgcgcgctagccggcatgtgctatgccgaatttgcagcctctattccagttgctgggagtgcctattcgtatggaaccatcatttacggtgaacttcccggttgggtgctaggttgggccttaattttggaatatgtcttagcagtagcggccgtttccactggatggtccgcttattttggttctctcctgggtggttttgggatacacatccctactgccatttctggatcatttaatccaagtcatggaacttacattaatttattcgcaattattatcgtcttgctaatcggatttttacttaatcgaggcttccagtcgtccattcggatcaataactttatggtctttgttaaaattgctatcattctaatttttattttagtcggaatcttttatgttaaacctactaattggaaaccttattttccatttggcgtgcacggtactttagccggtgcctcaacggtcttttttgcttatttaggttttgatacagtttctgcatcagcagcagaagttaaaaatccttcgaaaacgatgcccattggcattatcggaactttaattattgccaccatcttctatgtggccgtttctttggttcttacggggatggttccttacactaagctcaatgttgccaatcccgttgccctagctttacagttagtccatcaaaattgggtagccggattactttcattgggcgctttagccggaatgactaccatgatgatttctatgatttatggaagttcccgtctggtatatgctacaggacgcgatggtttgttgcctaaggtcttaggaaacctagtgggtgaacatcattcgccacgcaatgccatggtggtagttaccatttttatcgcctttctaggaggcttcgttcctttagatcaattaactaacttagtcaatatggggactttactagcattcgctttggtatccttgggaattattcctctgcgtcatcgccaagatattcctaatacgggctttaaagtacccggatatccatttatccccatcatttcagccttggcttgtatctatttaattaccacactttcggtggaaacctggattggttctgccatctggtttggaattggattaattatctactttagttatggaattcatcatagtaaactggcccaataaaaaaagagttgtgataaaggcaaatgtctttaatcacaactcttttaatttatttcatactaacttggaagtttattaagcacatatagcattagtgcgaaagcgaccattaaaatccaaacaacgtaattaacttccttacggcgaccagcaacggtcattaagattggataagttaagaatccaaatgccattccgtaggaaatattgtaagtcaatggcattccaataatggtgaggaaggctggcatagcaatttcaaatttatcccaattaatttcacgaagcgcagaagccatcaataccccaaccacgattagagctggtgcagttacttgcgttgtaacgactgttaaaagtggtgagaaaaacatactaaatacaaacaagattccaacggttagagaagtcagtcctgttcgtccaccaactgcaataccagcagatgattccacataagttgctgtgggtgtagttcccattactgatccagctaacattgaaattgaatctgccattagagcctgtccaattcgtggcattttattgtttttcataattccagcttgttgagctaacccaattaaagtaccagcggtatcaaaaaacgcaactagcaataagattaaaactacggcccacatctcagggtcagcgattgaaggcaaatgagcaattcccactccaaatgttggtttcatactaggagcaagggaaatcaaatgctccggcattttaatcaaacctgtcaccaaccctaaaatcgcagtggaaactaaaccgataaagattgaacctggcacttttttcgccattaaaatcgcgattacaaaaattccaaaaatggttaaccacgttgtgggaacggacaaggaacccatctcaactaatgaggtcttacttgctgtaactaatccaccgccttgcagcccgataaacgcaatgaagatcccaatcccagccgccatagctaatttgagatctttagaaattgaatcaatcacaatttcacgtactttgaggaaggataaaattgtgaataaaacagaagcaataaatactccggccatcgccttttcccatggaattcccattcctaaaacaactgagaaagtgaaaaaggcattgtcacccaatccaggcgcaatcgcaatcggataatttgcaagaaaagccatcaacgcacagccgataattgctgaaatggccgttgctgtgaaaaccgctcctttatccatcccggcttgccctaggattgtaggattaacaaacaaaatgtatgccattgaaacaaaagtcgttaaaccggctaaaatttctcttttaaccgtagtatgttgttctgtaagatgaaacgttcggtctaataatccatatgaagcattatcatccaatttttgatccattatttcgttcccccatcaaaatcttttttatcaacttccatattattccatactttaatgttgttttcaacacctaatgttcgtttatagatgcttataaacgtcataaaagcttatttttttatttcatgaaatttaaaacgaactttttcttatttttaaaatatttcaaggcctaattatgttttattgctttaggcgtataatatgaaacataaatattgtggaggttccatgttatgaaaaacaatcaattcggtcgaatacgactggatcgcactactgaacttgaagaattaaaaaacattcattttattgatgctgatttattagctgatccgaaagcccagttaaaagattttctaaaacgttcttgcctcgtaagtaatagcgaagcaactttccaacaaaagttaagcaatctactcgcaacccctgatcaaactatggcggcttttttcgaaagtgatcaaccactaactttagaaatttttatcttattagaactccaattacttcaatttgaggccgatactgattatcaaattgaagatccacttagtgccattagcaaaattcaacttccagaactcgatctcaaaaactttgaaactagtgcggatgtggcacacgcttggtataacttactaactacccacaccaaaaatggagaagtctatttagaccgcctaactcaacaaggttatttcgttagtttttacccaacgaccactaagccccttttcttcaatggaaaagcccaagcagtcttcgatcctcatcagttgatccgtgaagtagtttatgtggaagcccctctcgatactgatcatgatggacagcgcgatttacttaaagccgaaattttacgacccgctcaaactgctcatggataccaagctccagtcctatatacagcgagtccttataatcaagggacaaatgatagttatggagaagcaattacgcacaacgttgatgttcctttaactgaaaaagcggttcaaaaaatttctaaatccgacgtcactgccgaacccttcagccaaacacttcctgctgaacgtaaagtggctggaatggctacaaaagcaagtgaaacttttgctcgcgaacagccctatactttgaataattacttcttatctcggggcttcgccgtggtttatgctgctgggattggtactcgagattctgatggacttcgtgatacgggctctgtcgaagaaaccatttcaactacagcaatcatcgaatggctagccggcaatcgacgcgcttttactaacaaaactgataatcttgagattaaagcttcttggtctaatcataaaattgccatgacgggccgctcttatctaggcaccctcgccactgcagctgcaaccactggggtggaaggcttagagaccatcatttcagaagcagccatttctagctggtacgattattaccgagacggtggtttggtcgctgctccagatactttccaaggcgaagatatggatgtcctggccgctgaagttttaagtcgtaaacatgatgctggggattatttaggcatcaaagcccactttgatcaaattttgaaacgtattgaaaaagatcaagaccgtgactcaggtaattattctaaatattgggacagtaagaattatctaaataacgttaaaaatattaaagctgatattataatggttcatggcctcaatgactggaacgttaaaccacgaaatgtaggtaagctttggaacgctgttcgggacttaccgatcaataagaaaattattctgcaccaaggtcaacacatttatatcaatgcttttcgttcaattgatttcaccgatatgatgaatctatggcttagttacaaactttttgacgttcaaaatggggctaacgaagtccttcctaatgtaatcattcaagataatgttgaacctgaaacttggaacacttatcaagattggcaagcagcggacgatgagattcgagaatttacactacaagctaaaacgctggtggatcgtgcttctgagactaaaaacgaggcagcttcatttcgagattcccttgatccagaatttttcgaaatgtataaaaatgatttaaagcattggcatactgatttgctaaacacagaacatgccaccaatggtaaaaatcaaatgcgtaataatcgcttgatttttaaaacagcacaaactaaagaagattggttaatcgatggtacgcctgaagtttccgttaacgtagcagttaaccaaccatttgggatgcttagtttccaattagttgattttggagatgctaaacgtctcaatccttcacctagcattctccaaccacgctctttgagtggtagttttgattggcggactgatgatctacgcgaattcacgcttcaaaatgcggtcactccttggaaaatgatttccaaaggccatatcaacttacaaaatcgtactaataattattgtgttgatgaagttaaaccccatcaattctatgatgtaaaattagaacttcaacctacgttctaccgcttattagccggtcatcaattaggactagttatctatgctactgattttgagactaccattcgtggtaaccaagaactgctttactctttacagttaaaccaaagtcatttaaaaataaagttagcacactaatttaatttttaaatttattattgattaaaccaatggtaaatcaatatgggttctggtcagtttccttcaaatctgatattataagcttaaatttaagaaactaggtgagtgttttgaaacaaggaacaacaattttaacactagataatggataccatttatggtctcacactgatggtgacgacgattcaatccatctattagctcttcacggtggccctggtggaaaccatgaatattgggaaaacttccacgatgaacttttaaagcaaggcttgaatgtccaagtacattactatgaccaactgggctcatggtattctgatcaaccagattactccgatcctgaaatcgccgaaaaatatctatcatatgattacttcttagacgaagttgaagaagttcgtcaaaaacttggaattgatcatttctaccttatcggtcaatcatggggtggcgcattaacaatgatgtatgctcttaaatatggtcaacatcttaagggtgctatcatttcatccatggtcgataacattgacgaatatttggaacatcaagatgcaatccgtgatgaagctcttgctcctgaagatgctcaattcatgcgtgactgcgaaaaatctggtgactgggacaacgaacgttaccaaaaattagttgacattttgaatgctgcttacgttgatcgtaaacaaccagttgcaatccgtcatttagtaccaactatggctactccggtttataatgctttccaaggcgataacgaattcgttgttactggaaaacttaacgaatgggatgttcgtgaccaaattaaaaatatcaatgttccaaccttattgacatttggtgaacatgaaactatgccgctagattcagcacgtcgtatggctgaagttattcctaacgctaagttagttacaacgcctaatggtggccatcatcacatgattgataatgcaccagtttacttcaaacatcttgcagattatcttcgtgaagttgaagctggaactttcaataagtaatctaaataagtcatatttaaaaaggactaactaatttttagttagtcctttttactagcttaccgcctgtaaaagcgctattattaatatagtttattggtaatcaaggaggctttttgatgaataatttaacagatacttatacccttaacaacggagttaaaatccccgtagttggttttggaacttggcaatctaaagatggtgatgaagcttataatgcagttaaggctgctttagaagcgggctaccgtcatattgatacagctgcagcttatggaaacgaagaaagtgttggcaaagccattaaagatagtggaattgatcgtaaagaacttttcctcacgtctaaattatggaatcgtgaccatggctacgaatcagctaaaaaagcgttagatactagtttagctaaattaggtactgattacctcgacttatacctaattcactggccaaatccagtccaattccgtgatgaatggcaacagcgcaacgctgactcatggcgtgctatggaagaagccctcgatgctggtaaagtacgtgcgattggtgtatctaatttccgtgctcatcatcttgatgaacttttgaaaactgccaaagtaactccagcagtcaaccaaatcttcctaaatcctagtgatactgaagatgaagttgtggcctacaataaagaacatggtattctttcggaagcatatagtccactaggaactggtaagatttttaccattccagaacttaaagatatcgctactaaatacaataagagtgtcgctcaagtcgtacttcgttggtcactacaacacggcttcttacctcttcctaagtcagttcacgctgaccgtattaaacaaaacaccgaaatctttgattttgaactttcagatgacgacatcaagaaaattgatgatttccatggtgtagctggtctagctcaggatccagataccacagacttttaagctattgagtattaaaaaagcaaccccacggggttgcttttttgcttggttattcgcgatctagacgtaatttttctacgttaatttccttatcaatccattgggaatagaaactatcctcatgggatacaacgatcaaattgcctttaaagcgttgtaacgcttcacttaaggcccgcttcgtttcatcatccaaatggtttgttggttcatccatgattaagaaatttgaatcaatcaactccattaaagctaatttaaccttagtttgttctccaccactaagttgtttcatcggcttcatagtatcagcagcattgattccacacttagccaatttagtccgaatggttttaggcaacatcttagggtattggttttgaatggtttctaatggtgtcaatttaggattatcccatattaattcttgggtgaagtaattaactttggcagatggtgaaaaatgggcttctccacctaaagctggaattactcctaagatactcttaatcaaggttgacttacccgcaccgttaaacccagagaaagctactttttcgcccgccgacattgaaaatgtcactggttcaagcaattgcttcttgccgtaacctaccgctaatttattcacagcaactgcattttgagatccagtatcgagatatggaaaatcaaaatgaccctttaagttttcactaggtggatcgattttttccatccgatttaacatcttctcccgtgatttagccatcgtcgaacgttggccagctttattcttacgaatgaagttttcagctttttcaatcactacttgttgtttctcaaacgcttttaattgggcttccttacgcgcatctttttgacgcattgctgattggaagtcaccacgatacttagtaattttattaaatgaaacatcacaaatacagttagtaaccttctgcaagaaatcgtagtcatgggaaatcaccatgaaagctccttcaaagccatttaagtaatctgccaaccaactaatatgagcagtatctaagtagtttgtcggttcatccaaaattaaaacgtctggattttgaagaagtaacttagccaaaataatcttagaacgttgtccaccactcatttcgcttacgatatgatctttaccaatatcgtcgagacctaaaccggtcattactcgattaatttccgtatcaatgtcatagaaattattggcatctaagttttcctggattcttccagctttttctagcaacttgtcgtctaaattttcagcataatctgcatagtacttctccatcaaatcacgttgacggaataactctgcatatgcggtcgttaaaaattcatacaaggtatcttccttaggaatgtccgcatactggtctaagtaaccatacgtcactttattttgccaaataatgcgacccttgtctggtaacgtttcccccgttaaaatcttaattaacgtacttttaccagcaccattttgtcccacaattcccatgtggtcttctttatttaactcaaaatttgcatcttcgtagagctctttgtccgcaaaaccgtggctcaaatgctcaactgataataaactcattttttcaccttaacttttctaaaataactaataaccaccgtagcatgaatttatacaaatcgtcaatccaatttgcctatgctatacttaatctcgttattaggaggacttacatacaatgaatattcgtgaaattgatcatattacgctaactgtatctgatgtcgctcgtagcgaacgcttttatcatgaagttttcgatatgccgattctaaccgatgctccattcgcgggggttcgcgctggcaaacaacgaatttacttcgttactccagaccaacaaccccaatttgctccagctcaagctactactggtagcattgccctttccgttgttgctaaaaatccaatggaagaaattgttaaccatctcaaaagttatttcatcgaaattatcgacgatcctaaaactcgccaaggaactcatggcaatgttcaatcactcttaattaaagatcccgatggtaatctgattgaaatcgctaattactaaaataacgattaggatgtaaccattttagcatcaaaaacaaaaggaagtctcgactaaaaaagtcaaggcttccttttttgcttctacaaatacttagcatcttcaacaggatcttgagatgttaaaatcttaggaccgtctggtgtgattactagtgtgtgttcgtattgacaagagagactaccatccattgtagtaacagtccaaccatctggagcggaagtatcacattgccatcccccaacattaaccatgggttcaattgtaatcgtcataccattcttcaagcgaggaccatgtccagcttcaccgtatccagggaccattggatcttcatgcattgtaggttggataccatgccccacgaattcacgaacatcgccataacccatttcatcttcaacatatgattgaattgcatgaccaatatcaccaattcggttgccttctacagcttggtcaatcccaagatataaagcctttttagtaacttccattaattttttaacttcatcgctaacttcgcccacagcaaaagcccagcatgagtcagacatgtagccatccacactaacaactgtatcaaccttaactaagtcgccttctttaaggattaaacccttacgtggaaagccatgacaaacttcattattaacacttacacaggttgcatattcgtagccttcaaatcccttttcttcaggaacagcaccgtttttgtctaagtattttaatgcaaacttttcaatttcccagcttgagatacctggtttaataatgtcacgaagcccgatatgcataccagcaagtactgcaccggcctttctcattccttcaatttctcgttctgactttaatgtaatcattctatccacccgtttcttcataactaacgtctatactatcacaattttggcgaccaaattagtccaatcgctttactaccagtataagtacctacatacggaccaatctgtcgtgactcaacttgcattccagggtatttagcctttaaagtgctttgccactgcatactacgatctacatcattggcatcaattacagttactactaaattggtatggtcaactaattgtttgtcaaaaatttcttcgattgcttccatcgcattcttcatttgccgttctttaccaaccatctctaaacgcccttggtgattaatagttagaatggggcgcattccaaaaaatgagcctactaacgaggttcggttagaaatatttcccatattctgaagttctttaatgttatttactgcaatataagcttgagtctgtcgacgatatttacgcatttgatgtaaaacttcgtggatatctactccattatctagaagatgagatgctagaatggcaaccttttctacaccagctaaaatagaacccgaatcataaggataaacctggagatccttaatcgctggaaccgatgctgatacactattgataaaaccactcaagcctcccgataaaccaatgcacaaggctgcttcataacctgcttgagctaagttactaaagacttcctgcatttctttcattggaatttgagaagctgtaggatgatacttttcaagcttaagcattcggtaaaattcatctgaatcaatgtccatattctcatgataaacatgtttaccaaacataaccggttgattaacgatcgtaaaatgatacttacgcacgatttccggagctatattggctgaactatcaatcacaatcgctgttttactttggttcattttctgatatcttcttttctaagtatttggctaattttgcttcaggataataccccgtcactttttcaatggcttttccatctttaaacaaaaccaatgctggaatgctcataattttaaaagattctgctactgcttgattgttatccacattcattttggcaaactggatttgatctccataagttttttccaaactctctaaggctggttccatcattttacaaggaccacaccaaggagcccaaaagtccacaatggttagtccagattgtgtcacgtcagttaagttatcttgattaattgtaacggccatttctgtctcctttttactaacttgttaccataaattatatcattgtttttttgccggtcttttggcatagtgaattccaattgtaattaaaaaggctaagatcacaattcccgcaaaaacaatcgatggaatttcaatatcaatcattggaatggacaataaaagttttaacgcaataattccaattaatacgtatgccatcgtttctaattccggaattttttgcatcattttcatgattacttcagcaatgccccgcatggctaaaatcccaatcagaccaccaattaaaacaattaccggattagatgaaattgctaaggaagccaagactgaatcgacggagaaaacaatatccataaattcaatttggattaccacccgccagaacacggaaagtcgcccttcttttttaactagttttcgcgtcttacgtcctcttttttgcttgtcaaagaacctaaataccaagtaggctaagtataaagctccaattacctttatttcccacaagttaattaaaaaggtaccgattccgataacgataaatctgaaaatataggcgccccataaaccataaaatagggatttttcacgttcttttttatcttctaaaacttgtgtttgagttgctaaaaccactgcattgtcgaccgataagatacattcaatcattaccaatgaaaaaattactaaccagtcggaactggaggacaacacgttttcccaattattaatatcgaaaaagggtccatataggtttgttaatatattcaataaattctttctccttttttcttctaaacactttattttaatcgatttagtatattttttcatcccattggggttaaactaataatattaaatacagtgaggattattactatgctaaaagttactaaaaagtctgacgacttttcttggattcaagtttccaatcctagcacgcttgaacttcaaactttagtcaaaacttaccatgctacatcggaagctttaagctatgctattgataaaaatgaacgagcacgggctgaaattgacgaacccaataacatttttttgatcatttttcatgcactcagtgctaatttaaaagaaggcgttcaaaccgagcccgcggcattcatgtttctaccaaaggcgctggtggtttttacgcatgattcaactcactatgtgaataaacttttagatcgcaatgttaaaacactaatacgcaaaaatagtgatcctaattttgaatttaataactcgtttatggtcaacgccgttttcaatacgatctatgaactaacgattcgctttaatgacgctgtttcacgaattaattttgaccgtcaagaaattcaaaataaatttaaaactcgtttaaatcacaatggaattcaaagcatgctacagttggagactagtttgatttatttattaacatctttgaaatcaaatacttcattattaaatagcatgcttcgtatgccaaacttaaaattaactaagggacaacgtacgcgcctagaagaaattgtgattgagtctgaacaaagtcaagaaatggctcagctctcatctgatatcatcgaacaagtctccaaatcctactctgacatcttggataacaacttaaataacacgatgaaatttctaaccatcttatctattattttagctgtccccaacattgtcttcggattttatggacaaaatgttagcctaccaatggccaatacgccttggagctggacactgaccattctaatttcgtttgctttaattttgattgtctatctcatcgccaactggagcaattttttcaaaaaataacgttaataaaaagaactgtaactactgtctcaggctttcaccagcctgattcgtcgttacagttctttttgtttgcgttgccgcaattgcattacccacgctgtcaatggcaccgtgctaattactccaataaatccaattagaatcattgaaagttccgcagcaaaaattttgttattaataaactcactaaaactgtattttaacttaacataccaaatgaataatcctagaaaactaccaaagaagccaaaaaacaaggtatttaaagctgttccaatgatttctttaccaatttcatatccatgtacaaacaatttactgtagtctaggtctggagtagtctcaattaattcttgtaacccagccgacacagcaattgccgcctcagctaccgctccaagcgagctaaccatcattgtcgctaacatcacatcactgaatttaataccaattaaaagtgacatcccctctaaatcttcattattttcattggcaaatccatgaactaacaaatggggttgcagcaataaaattaacccgattaggaccatcaaaactaggacagaactgtagaaagcattttgggtaatttgatcatcatcactgcccataaaaatggtggttgcaaggataatcaagccactaatacttgttattactagcgccggaaatccccatgcaattaatgcaatatttaggaataatatggcaaaattgaagataatacttaaaaaggcccggactcccgttgcaccgcccacaataatcattaacagggctaaaattagcatcaatattaaagttgcgctatgcatgttgcaccgcccccttcttaaagaaaatgccaaccagccagctagcaataggaacggttaatacaatcccaattccactaattaagctttgtacaaatcccagttgcatgttcatttcaaacgagtagctccaaccgtttccatttctaagatacagagccatcattgaaaatgtatctgccataaatatcatgaataaaacgttaaggagaggacccataattgttttcccgatatttcggccggaaatccagagctgtttcattgaaattagcggattttcttttcgtaacttggcaagactaacaataatgtcagttgattcatccattaccgctcccaatgatcctagtactgtttcagctagaaataaaggttcgggattttgtgttacgtactccatcgtttcaaaatgaagtcccccattattggtaagtctaaagactaataaactaatagcgactgcgatgaaagttcctaacatcgtcgttgtaaagcttacccacatttttttgttccaacctaaaactaatactaacgttaccgcacaaaaaacggccgcgattccgctaaaaatccaaaaaactcctgagccctcttgctgaacatcgatttccactgcaataaaaaataaaatggtgtttaaaatcaagcttaagagcgcccttaatccggtcgacttcatcattattaataagccgattaccatcacaattaagatggtcaaaggcacgtcgcgtttcaaatctgtaattgtagctgtcttaatctgatggtggtgtcgggttaaatgtaataagaccgtttggcctttacggtattttaaatccgtcgcctgcgacttagtatattcattattaaccgtgataattcgattacgctctttaccatttaaaattttcactttaagctgttgtcggacactgtaatcttgatttttaaaattatcaatttggacagctttactaatttttttaacactttcaatacgtccaaccggtgtttgatataaaaaagcatcatttttaacaaagaagaccgctgcaagccccatcagcacaatacttagtaccaagattacttttttattccaatacattaaatcgccttttccatccaataatgtacaatgcccgcttccatttctgggccactaacgcgctcgtaattcatcgcaaagtaaaatggttccgcactctcttgagcatgtaatttaatttttttaatgttcattttaactgcttgggcttcaataaattcaaacaaatcacgcgctaacccatgacgtcgatatccagttttagttgccactctttgtacaacccaagtatcatcatcgacgcgtcgtgctcgcgccgtcacaatcggtttagcttcgtcgtagcccacaaagtaagtaaagaaatcttcattttcgtcaaattcaagagccggatcaatgccctgttcttcaataaatacttttttacgaatttctaacgcatccatataaactggtccagtagcacctctaaccattttagcttccatactagttcgcctccgaaactatcttttaataatatatctatcatattaacccagataacttattaatggctgcttaattcagaagaattattaaaattttattttattcatcccccttacccaatagttaaccaaatcatttaaaaaaatatggtaaaattgcatttatgcattaatcttgttctatttgaaaggtctttaaaaaatgaaatctttaaaatcaaaaattgatactagattcggattctttatccttattactattttattttgggcgaagactctgtttgcatatctagctgatatttcactaggtgtaggtagtatctttcaatggataattcttttaattaatccagttgctacaaccgtcctcatctttggacttgcattatatattcgaccgaaaaaaattttttattgggtagcgatgttgttggatgtcgccaataccgtcatgctctatctcaatgtaatctactttagagaattttctgactttatgaccgttaatactatgttgggctattccaaggttaatcaaggcttaagtgctagctcaatgtccttaactaatgttcatgatattttctactggttagatatcatcgttattttcttattactcgttctgaagaaaataaaaatggacccccatcctttacctaaaaagtttgggtttcaaatcacctcactgggctttttattttttgcatttaatctaatgctcgcggaaatggatcgcccgcagttaattactagaacttttgatcgttcttatattgttaaatacatggggctcgatgcctttactgcttatgatggtgtccaacttgaacgtaaccataaaatgcgttctgaagctaagaaaagtgaattaacttcaattgaaaaatatgttaagcatcattatgctaaaccgtcgaatgttacttttgccaaggctaagggaaaaaatgttattatcattcacctagaaagtttccaacaattcttaatcgatgataaagtggaaggccaaacagtcacaccattcctaaacagcatttatcacagtaaatcaacttactcatttagtaactttttccatcaagttggtcaaggtaaaactagtgatgctgaaaatatgcttgaaactggtacgtttgggacagctcaaggttcactgttcgctcagttaggatctgatcaaaccttccaagctgctccagcaattttaaaacaacatggaaactacacttctgcggttttccacggtaatactgcttcattttggaatcgtaatagcacttataaaaatatgggttatgagaacttcttctctgccagtgattttgatgtttctggggataaatctactacctatggtctaaaagataagcttctcttcaaagattcaattaagtaccttcaacacttacagcagccgttttatgctaaatacatcactgtaagtaaccacatcccatacactttagatgatgaggatagtacttttaaaacgcctagtactggcgataaaactgtagacaactacttcaaaactgctaattacttagatcaatctgttgaagaattctttaatttcttaaagaaatccggtttgtatgatgattcgatgattgttttatacggtgatcattatggaatttccaattcctctaatacagcactagctaaaacttttgaacaagatccggatcattttaaagaattcggctctaatccaactgaaaattggaataattgggataattcacagctccaacgagtcccattaatgattcacattccaggtatgaaagatggtggcattcaatcccaatatggtggtgaaattgatgttctaccaacgatcttgcatttattaggaatctcaaccaaaaactatatccaatttggtactgacctgttgtctaagcaacatgaccaagtggttgcttttagaaataacgattatgtaacaccaacctatagttctatcggtggtaaactttatgacagttccggcaatgagattaccgatcctaacaccacttttaaaaagaaagttgaaaaagatcgtaaagctgctaaagaacaattagcgatgtcagattcgttaaatgaaaagaatctcctccgtttctataagaatccggactttaaaaaggttaattcagctaactacaattattcggatggtttaacgaaagccatcaagctagaagataaattaggcttaaaatcgacttctatgttctccaagaatcaagataaatcacttgaagatttgtacaaaactaatgctcctgaagcaaaccacaaatcaactagtgaaaaccgaattaaaattacaaatccagatgccaatggcagttaacaaaaatgcagtgaacttagtttttaagttcactgcatttttatatattcagattatttttcaaacatggatgtactatgaacaggtccacgtttgcctggatataagtcgttcataatttgatttaccgcaatcgggccttcaccaaaggcggttgcaattagtcttaactttccaggatactctaccccatcaccaatcgcgtaaatatttttcatatttgtatgcatcaggctatcgacggcaaacatacgatgttcttgggccaaatcgatttcccatcctttgataattttattactagaggtaaatccgtagttaacaattagtttatcaaaatgggtagcttttaaggcttcggtaccaatttctttcaaatcgacatcgattccttcgacagcctcgcgaacatcattaattaaatacggtgtcatcactttaaccgtcgattcttggaggcgttgtacattccgttccatccccctaaattgctgtcgacgatgcaccaaactgacacttttagcaattggttccagcataagcgcaatatcaatggccgagtcaccaccacctgccactaaaacatcctgattttcaaaatgttcaacatcgggcatatgatagtagatttttttatcttctaaatggtccaacccttccacagctaactttcgcggattaaatgctccattaccagttgctaaaagaattgctcgggtatcgtattcattccgattagttttaacatggtaaaaatcagcttgagcttgaatatcaacaacggtttcgttaagacgaatttcagttccgaccaagcgcgtttgtttttcaagttctttagccaaattagctgcttttattccagcataaccaccgacatcgtaaatcattttttctggataaagtgcagcaacttgtccaccagcttgtggaaggctttcaataatttgtgttttggcagtgcgcattccagcataaaaaccagcaaataaaccggctggacccccaccaataatcgtaatatcatacatttccgtcattgcctgtgctcccttattaaatcaatttcatttttataatccaccaaatatattaccagcttcttcaataaaaaagaatgcttgggattgtcttttaagctttgtttacgtatgattaaagtaagtttaatacataaattgtttattcggaggggttcttttggcaactaaaaaaatgatcttagatctagatactggtattgatgatgctatggccattgcatatgctttggcagcacctgacgttgatttgattggtattgtttcgacatacgggaatgtgttaacccctgacgctggtactaatagcttgaaaattcttgaattactaggccgaacggatattccggtctttcttggtgaggaacactcacaaactaccgaaagctttgaagttatgcctattagtgctcaaattcatggaaaaaatggtattggtgaagttgaactacccgctccatctcgggcaattgaaacacagcccggggttgattttattatcgaagctgctcacaaatacaactccgatttaattctagtgccaaccggtcccctaacgaatcttgcacttgccttaaagaaagatccagaagtcgccgatttaattggcaacgtaactattatgggtggtgctcttactgtccctggaaatgttagtccagttgcagaagctaacatcaaccaagaccctcatgctgctaatgacgtatttactagccacgttaacttaaccatggttggtctagatgtcactttaagaacgttactaacaaaaaaagaaacgcaactttggcgtgacctagatactactgctggtagtaaatttgctgatatcgtcgattactatatcgacgtttacaaaatcaccagtcctcatcttggcggttgcgccttgcatgatcctttggcggtaggaattgcccttgatgcttcattttccaaaactatggatttaaacatgttcgttgatacaactgacgaaatgtggggtcgtaccattggtgaccccggccgtttaaacgaagaaaatcccaacgtttccgtagctttgaatgtcgatgcagacttttatctcaagcgctttatggattatctcactaaattatttgctaaaaattaatatcttctataccaaagccacaaaaatcgatttttttgtggctttttggtacgcttggtttagagaaaccaaaaaaggagtcgttgtgcatgtccattgtatttttcgttttgattttaatcatcgccaccgttttttcaaacgcattagatactaaaatcaaatttttaccacgggctattattcaaattatgatggggttagcactttctttcatccccaatttcaatcatttcaatcttaaccctgaagttttcatgctagcaattattgcgccgcttatgttttacgacgggatgaacactaacattgtcaaacttaaacgtactctgagtaataccttttctctagccattggactagccgttgtcacgattattctagttggttacttgggatatgctttattaccccatatcccgattgcccttgcctttgctttagccgctattattacccctaccgatgcggttgcagtgtcatccgtgaccgaaaacctagatcttcctaatgaggccatgctgagtctcaaaaatgagtctttgtttaacgatgcaagtggaatcgtaatgtttgatttagctttgactgcctttcatacgggacatttttctccggttctaagtatttttaattacctatatgtcttctttggtggcttaattgtcggctggattgtcggttggctttttgttcgcttacagttactcttaattgaaaccgatattgataaccccaacattattgtccccatcaacttcattaagccttttgctatctaccttctggctgaaatgtttgatacttccggaattttggctgtggtagcaactggattgattcaaagtactcaagctcaatccttacgtcttacttcaaccaaaactcaaatggtgtctaaaaccacctacgaaatttttactaacttaatgaacggtttcgtttttattcttctaggagtttcatttccaaccgtcatctacgatattaccaatgaaggccgtcaggtttcttcgctaggttatctcattttggttggtatcattttgtacatcgtcatgattatcattcgctacctatgggttactttaaaactagccaacatccgtatacggccagccgataaagtacttaatcattttttaattgctattaatggtattcatgggactattaccctatcgatggccttttctattccgattgtattacatggtaagatttttccattccgcaatgatattattttcatcgcggcaaccgtcatcattctcagcttactcgtgccaagtattatcttaccgttgatgttaccagccaaaacttattcctacagtttagaagatattagcacctaccgccaaaaaatgattgaatacgccattaaacgcgtccatgatgccgatgaagatccggtcgaaacgcaggcggtgattgctactttaagaagccaacagtctatcttacaacgtcctaaacgaaacgctacttacaaaattttacagaaatgttttaatttagaagagaaactacttcaagagatggtggataatggtgaaattagcgttaaacaacaaactttttacgaaagaatgtcattgttccaaagtttccaactccatcaatcgtttatccagcacttcatgtatcgagcacgtttttactttattaaattaagccatcgtttcaaacgacgcattaaacgggtagatcctttggtggttaccaaaaaattcaataatgctcgagacgaattagctcaagtagaaaatgaaatatcgcctcagatttttgcttatctcagagaacatctaaacgcagacaatcgagcagaaatccactggattgaagagtactatcgtgaacgtcatcgtcgttttcaaaacaacactcgtgctaacgaaattcaggaagaactttttattaacgccttccaaaatgagtataactttattcaagaacaattaggaaagaaaaatatttctcgtgaactggctagtttgctatatgaacaggtctccaatgacgagtgggtttatatgcaaaatgatagtatttacgcataaaaaaactatgataacaagtcaccttacactgcttagtgtcagaggcaaccttgctaccatattttttttaatccatatatttatctaaaaatttttcaactgtttgtttatattttttatagttagtattcatcgcttcagcatgtttagcacctttaaccacgtacttttcctttggtcccttggttgcattgtagaggggctctagcattgaagtaggaacgaaggtatcgttagaaccatgaataaacaacattggttttttattcttagccaattgcttcaaggcgctggcttcagaatagtcgtaacctgcacgaattttagaaatcaaactaactgttggaactagcggatactttggtaaatgatacattgatttagcttgatatgtaatttcatcatcaacgctagtataaccacaatcttcgacgtaagctttaacttgcttaggtacatcagcttctccactaaccatcatggtcgtagcgcctcccatgctaaccccgtacatgacgatttgctgatttttaccctcagtcttcaaaagtttgttcatccacttaatgtaatcgcgtcggtcggtccaaccgtaaccgattagtttgccttcgctttctccatgagcacggtcatctggagctaatacattgtaccctatttcgtgaaacatagctgccggagcaccttcagcttctttactttgtaaaaatccatgtgccattactactgtcttattagtttgatgttcagccgggatataataagcttttaacttcaaatttccggttgctgaagtcattgtccattgctctttttttacgttttgataccattctttttgttttcttaatggatcattcttaagtgttttttcacttgaaataaaacttttgggtccccgtacttcagctacgtggaagaaatacattcctgctccaatatcaataaccaataatactccgattattattaacaaccatttccataatttcttcatcgtactttcctcctagaactaacttatttagtatatacggattatcaaatttgtggataacaaattctccttaacgtttaaaaaatagtttaatttcataataaatttatcagccgttaggtttgatttttatttttagtacgcgtctttattagttttatttcttacaaaaaggttgtatcaacccatcataatttctgggcgccaaatcaatcctcgtttgtgacacttactttaatttgtcgcattcccccattctgtattaaaatgagtatagacagattgtcacaggaggatagcacatgtttccagaacgcttacgtgctttaaggcacggtaaacacattactttagaagttcttgccaaggggttgaacgaactttttccagatgagactcccaatacatccagccagattggaaattgggaacgtggtattcgaactccctcatacttggaagttaaaaaacttgcagaatatttcgatgttagtatggattacctttgtggtcgtgctgccttgaatgaatatgatttaagtaaattattcctatcgggtcgccaattgagctttgatcataaggttcttagtagcgacgatcgctatgaaattttccaattaatggatggttatttccatggtaaaaagcgtcgtacgctaagcccttccggtgaacaagaagaactcgctttgaattggaataaaacaaaggacgaatcttaatgaatcctaaaaaattaaaaaaactaaaacgtcaattaaaaaaggaacgctccgtttcaacaactaacaactatattactcgccttgagcgctatcgtgagctttttaaacaaaatagcacgattacctttttaattaatcagatccttgaaagtaatcgtctgattcaacaaaagctcttacctcagcaattaccggtactagaattacccgaagatattcaagatcaaatttttaatcaaattaaggatcaatatcccctaggtgatcctagaggtgaccaattgtgggaaaaattgacagccgagctccctaaattggacaaacttttgcgctcctatcgcgactaccttgaagaaacctacggtatgtgggcgtatatttcagccccgttcattagcgatttagctcattatttggctggtagacctactctagaagttatggctggtaatggttacatcagtcatggattacgcttaaaacagcaaaacgtttatgccacagattcattagactgggttcaagaaaatgaaacaggtaaacatctcgtcaccgaagttgaaaaactggatgctatatcagcaattgaaaaatatggtaatcaagttgattttgtaatcatgtcctggtctccagatggaattccaatcgatgttcaaattctcgaaaagctacgctcgctaactaagcagcctaccttaatttgcattggcgaacctcatggcgccaccaatagtgctggtttttggaaaaccgctaaattaattgaacctgaaaatacccagcaacttaaccaacattatcaatcatttgatttaattcacgaccaactttacttaattaaatagacaaaaaaagaggatggacaaaattaattgtccatcctcttttaccggtcattaactaagttaacgcagtcgttaggtggctcacacacctattatgactcacacttctacaatacggtagataacgtgtgccggcgaaatggtcactagtcgccgcagcgaaacaattcaaagaattgtctgacctatctcgactcatcgcatgtatctaatgtaacatgaaatctattaacatacaacaccgattaggcgctgtaattgcaatctagcaaataagcctttatcattaataaagaaaaaagaaagcgaggtggataaatgtttgatctcatactcggatttgtgattcatcctttaacatatataacacctttaaccgaacaccttcataactgggtctacctgattttatttatctggatttttctggaaacagcttttattgtattttcatttttaccaggtcaatctgtacttttcctaactggaactattgcttccgcagctaattcacggcttaacatttttatcctaacgattacttttatcattgcagctactagcggtgccatcgttaaataccgttatggagtgaatattaaatctaaaaacaaaattgctaaacgtattagtgattccgaaaaaatgaaccaaactcaggaagttttcgatgaaaatactaaaaaatcactaatattttctcgttttattccctttgtcggtctttttattccaattgtagccgggaccacccaaatggattggcatcaatttaataaattaaatttcatcggtgtcttattatgggttggaatttgttgtttttcgggttatttctttggccaaaccccttttatcaagcagtattttactttgatattcttactattaattattattcctgctattttccaaattatttggcgtaaattaaaaaaccgtccagaggaaaaagcttaaaaactctagcaaagttagctaccaaaatctaactttgctagagtttttatttaatcatataaaaaaagatttagtttcgattagacctcaaaattaaatcttaactatcgtagctaccttcgcagttttatttcaacaaaccggattacaaaaaggaccactaaatagagcagtaacgcccatagtagtgcactaaaactaattaaggtggttcctaatattaatcttcccaaaattttaaatattagtaacaaccccactaagatgccaattccccataaaatttcgtctttaaaatgacgctttttcaacaaccatgtttgaacaatcctaatgtatttcaactttcataccctccggtactttttcgtaaatccattttgcatctggaaccgccaaacgcacacaaccatgtgattgagcttctttacctaactgttcagcttcatcctcaaggaattttccgtttttatcggttggaacagtatggaacagatagattccatgatctttaaaggatacccagtacttagcgccttcctttgaagttggattatagaagaagtcgccccgctcggcctgaattttataggtccctgttggggttggactttcatgtgatccagtcgacgcgtacatagtatataaaactttttccccgttcatcacatacactcgttgtttagcaatcgataccttcaaaaaagctttcggatatttgtctaaatctggataagcctttttttcagaagattttttccaattaactggattcatttcgcccttttttgattttgtggttgcggcttgaatttcatccccagctaacccactatctttagaagtgctcttaggcagtgatttctttttggctgatttttgtaactccactttttcttgctgaattacttgctgatgatgagtgtagatggagaggattaatgtagagaatgcaattacgattgctgttccaactattagttcaaatctcttcataggaacctcctattttattcctcattatctttttgatccttatctgggtgatctaatcgatcaaattgttccgccatccaatccttaaaattagcttgtaaatcaggattagcactaattagatcctctgccgtcccaatttgatcaattcgtaaatgagacgaattaattttttctgcttcaattactgcataaatattaacatcatattctttttctgcttcagttagtttctccacagggccgggataaagcaatggtaaattaataatattagattgaattttaataaccacacttttattaacattaataactgcttcagcaattgggctttcttgaatggcctgtttcaaaaaatctaaggcaggtttaaatcctgtaccgtcggctttttttaaagttgttttcccaattttaaattcctctgatttaaaactggcatctttcaatgtttggataacttcacttgctaatactttcattttgtccctcgtttttttgttttctaactatgagtttaacatctaaaagcccttttttacatagatatattgcgtatcgcactccaatatcactataattaagtaaaaattcagatacggaggttttaattatgaaaattggctttattggaaccggagtaatgggaagtggcattatccataatttattaaaaaatggtcacgatgtcgctgtttttactcgcactaaatctaaagcagaccctttacttgaagaaggagcccagtgggcatcttctcccgccgagctaactcaacaagtggaaacagttattaccatggttggttttccacaagatgtggaagaagtttactttggtgatcacgggattttttcaacagttacttccggacaaattttaattgatatgacaactagttcgcccatattagccgaaaaaattggtaaaaaagctgatgaactagatgttatggccttagatgctcctgtttctggtggcgacattggcgcccaaaatgctactctaacaattatggtcggtggtaaccagacagcattcgaaaccatgaaaccaatctttgatcaaattggacatgcaactaactattttggtacttatggcgccggtcaaaatgctaagatggctaatcaaatcatgattgccgggaccatgactggcttaactgaaatgttagtatacgctaaagctgcccagcttgacttaaagacagttctcgaaactttatccaatggcggtgcatcaaattggagtatggaaaactacgttccacgaattttaaaaaatgactatactccgggatttttcgctaaacatttccttaaagatttaaaaattgcacttgatcaagctaagcaaatgcaagttgatttacctgccacgcgtctggccactcaactttatgataatttagttaaccaacagggattaggcgacgatggaacccaggctttgattaaactctggtggaaataaaaaagactcgcagtaattaccacgagcccttgcattcagtctccatggagaagcagagtgcttaatggcggccgtagtcgccatttaatttgcgcaagttcattttaacgcatttgccgtctaattagaaatattttagtttatccggtaaattcgatgtaaaaaggcttacatttttttgtgaaaatgatatcattagtataagaaaagatgattggatggtgggtaacatgctacaacaatacaaaaatatcttagcacctgttgatgggtctaaaacaactgatgttgttctagatcgcgcaattgaagttgcaaaaagaaatgacactcatctcgatattttaaatgtccttgaagtaaatcaatttagtgatacttatggtggggcagttagtggagatgtaatctataaactttcagaggacgtccaacatcgattagaagaactcaagaaaaaagctgaggacgctggagttaaagatgttagtgttcacattcgttttgggaatccaaaaccagttattgcacgcgaatttccagctgaccataaaaacgaattgattatgattggttcaacaggacttaatgctttggaacgtttaatggttggttctgttgcaacttacgttagccgtaacgcgatttgcgatgtattgattgttaaaccagaaaagaaataattatcattaataccacatacttaaaggatcgattgaacattttgttgagtcgattcttttatttcgttaaggagtttcattatgcaatggcactatgctattagactttccagtttataccagcctcaaagtttacgagaattactgcaaagaacttggttattatcgcggaaaattgtccactttttacggattaacgaacgcgttttggttaatggaaaatatgttcccgtcagcaccatcgtccaaggtggcgacttaattgagcttaattttgaatcgtctgattttgacaccccccttccgccgtttgatccagattttacgcaagcgccaattattctttatgaaaattcggacttaatggtcgttaataaacctacaggcgttaaaactcatgctaatcaacctcatgaattgggaagcatgatgaatttcttacaagcttacttcaagtacaccgaaaacgaagcatataatgtccaccggttagatcagttcacgagtggcgctttgttagttgctaaaaatccagtggtcgtgcctattcttagtcgccaaattagtactaaagtcattaatcgcacctatttatgcgttgttagcggccatttagagcaatctaagggcaccattaacgttccaattggttttgaccccgatgataaacgtaaacgccaaattaatggtttaaatcccttatctgctattacccactatcaagtgctagctcagtatgaaaatagcagtcttatacaagtagatttagaaaccggtcgaacccaccaaattcgcgttcacctttcatatctgggtcaccctattattggcgatcctttatataatctggataatacccagcagccaatgttattacattcttggaaaattcgttttccacttccgtttaatctagaaacaatagaagtcactgctcctatacccgattattttaattttttaactaaataaaaaagctggaagctatgccctattggcaaagctttcagcttttttgttttgatttaattagttaacatctttccaagtccagttagtaacttctggaagatcatcaccgttatcacgaatgtattggtaatgacgttcaagtgtgttatccatttgttgagagaagtctgcacccttttcagcaaattctggaatagaattgattgtgtcttgtgctaagtggaaacgatctagttcgttaagaactcgcatgtcgaatggagttgtaatgtccccttcttcacggtaaccatgaacgtgtaagttatggttatgacggtcaaagaagattgaacgaattaagtcttcgaaaccatggaaagtaaagataactggtttgtccttagtaaagtaacgatcaaattcttcatcacttagaccattagggttaaccttaggactttgaagtttcaataagtcaacaacgttgatgaaacgaatcttcaagtctgggaagttatcatgcaagatgttgattgcagctaaactttccatatttggttctgtaccagcagcagcgaagacaacgtctggttcttcaccattagttgtgcttgcccagtcaataatacccaaaccgttcttagcaagaacttctgcttcttccattgagtagaattgaggacgaggttgcttagaagcaataatcaagttgatcttgttacgatcgttcataactagtgggctaatagcaagcaatgagtttgcatcagctggcaagtattcacgaatgaattctggtttcttttcagccaagtgagtcaaaagacctggatcttggtgagtgtaaccattgtgatcttgttggaaactagttgatgtagatacaaggttcaatgatggataatcattacgccaatctaattcatcagccttacgtaaccacttgaagtgttgtgtaatcattgaatccacaacgcgtaggaatgcttcgtaactagtaaagataccatgacgaccagtcaatgtgtatgtttctagccaaccttcagctgaatgttctgaaagttgagcatcaagaatacgaccttcaggagcaagagcttcatcccagtctttcttgattggagcaacaaattgacgatttgtaacttcaaacaaaccatatagacggtttgacattgtttcatcaggaccaaacattctgaagttagttggattcttagttataacatcgcgtaagtagtctgaccataccaacatatcttgtttgatgttttgtccacgttttgttgtatcaacagcgtagtcacgataatctggcaagttcaagtcagttgggttaactccaccgtttgtgattgggttagatgccatacgtttttcacccttaggtgcaatttctgcaatttcaggtaatacgcgaccattttcatcaaatagttcttctggcttgtatgacttcatccagtcaatcaaagcatcaacatgttcaaggttcttttggtctactgggattggaatttgatgagcacggaatgtaccttcaataaccttgttatcccaagtctttggacctgtccaacccttaggtgaacggaatacgattactggccagtatggcatagtttcatcgtggttttcacgagcattcttttgaatttcttgaatcttttcgatagccttgtccattacttcagccatcttaggatccatagcttctgaatcatcaccttcaacaaagtatgggtcccaatgttgaccatggaagaattcagttaattcttcatctgacatacgtgatgtaagtgaagggttacttaacttatagccgttaatatccaaaataggaagaacagcaccatcagtaatagggttgatgaaacggttatgttgccatgaagcagccaaaggacctgtttcagcttcaccatcaccaactacaacagcagcgatttggtctgggttatctaagatagcaccaacaccgtgtgataatgagtaaccaagttccccaccttcatgaattgaacctggtgttacaggagcagcatgtgaagcaaccccaccgggccatgagaattgtttgaagagtttcttcataccttcttcatcttgagtgatagctgggtatgcttcagtgtatgaaccatcaaggtatgagttagataccataacttggccaccatgacctggtccttcaacataaaacatgtttacaccgtatttgttgataacacggtttaaatgagcatagatgtagttttgtccaggaattgttccccagtgtccaattggatgaacttttacatcttctggtttaatgtcgcgttttaatagcggattgtcttttaaatataattgtcctactgaaagatagttagcagcacgccaaaatttttcaagcttgtcaaaatattcttttgatgaataatctgtcattgtactcttcctttcgtgagcgaaaaataggttgtttttaatttatgaatttattataaccgctttctcaaaaaaggtcaatcatttttcaaattgatacggtccaattttaaaaatgatacgaaatcaccttttcaacggctattctaacgtaaaaaagcatctaatcaaaattagatgctttgcttaatcgacagacacaaatgtgctgtaattcatatatttgtagtgaattcgcatatttgaaatttcaaacggcgtaccatcatccataaagaaaattccggacataacaccgacgggttcattttcggttaatcctaaaagtttttgatcttccgcattggagggttctacttgaatcgacataaacgaacgtgttacgtgttggccttgagcgtcctctaaataattaaaaatcgatttttccacaatggccttggataactccggcacaattttaattggaatatagcccgtttcaatcatgattggttcatcatctaacaaacgtaagcgacgaacttgatagacaaagtcaccttcatttaaaaataaatctgtcttcatattttccgtagcaggaactactgaaaaatctagcactttaattccctgctttttaccattggatttcaaactatctgtgatacctagattagatccttcataattaaaagaggattgacttttcaaatagagtggattgataaaagttccggaacctcgttttttaaaaactattccctcatgtgccatggaacttaatgctcttttgacggaactacgactcacgtcatattccgtagttaacgaacgttcatctggtaaacgcatcgttggaaattcattattaaagattctttttttaaggtcgtgaatgatttttttgtagatcagatcttccattaaactatctcccattgttaattgctttcaccattatagcaaacttgaatgctttgattttattaactaacgattttccctatgctaaaatacaagggtaggtggtgagatcatgggtaaaaagaagaaagaaaaagtctctaaaacccttgttgaacagattttagacaaaaacaaaattgaatacaagcaatttatttttccgacatttcaagatggtgatgttaagcaattaaacgttgatcacatcggtgttgatgatcacctcatttataaaactttagcattaattggaaataaaactggccccattgttggagttttaccagttgatgaacatctaagttacaaaaaacttgctaaaatttcgggtaataaaaaagttggtatgattccattaaaggatttagttgccaccacgggttacgaacatggggctaatactcctattggaatttatgaaactaagcactttcctatttacatttcagatattgccaaagaacaaggcacaatcatcgtatcttcaggaaaaattggtcgatctgttcaattaaaggcggaggatttagctcaactagttcacgggactttcggtgacattattgaatagtaaaaaagagaacctacgacaaataaatcgtagatcctctttttttatttaatcttagtcggttgatgttttttcgaatctttaaccactttaactaattgattagtttctaattgatcaacaatcatgttggaagctgcttctaaaagttgatctgttagattgttggcattacggtctggacgtgatagtcccatatgcttgattttattattaactaaatcaatgaagcgatcgtaggcttgtttgggatactcactagcagtcacccgatcaattcctgaacgaatttcttgaatggaaaaagattgttttaaaagtgtaattaataagatatcagcaatttgcataacttgatatttcttcttagtgggagcgacaattaccttatttttaacataattattaaccatcgccggagtcactgcttcaagtcccaaaggacccgtgtattcggtcattaatgccactacttgatccatataaagatcaaaattaggcaaatcatcccaatggggtaattcaattaatcgtactaattcaagccatctttggtattctttataatcactcataactagtgctcctttacttatttactatcattataacatcttcatctagttttaaaaactagttaacctcgattcatagaattgtttatcaaaaattagcatttatggtactctatttatatgcataaaaacggaggaaaatttaatgtttgatccaactaaaaaaagaaaagtatctgaagaagtaaaagcgatgtttccaatcgaagtcatcaatggtttatgggataccctacgtcaaatgaagaaggaccaaattgtcgttactcccgccatcgcattcgtttttagtgatgactctacggatgaagaaatatacgtcatgggacttcaaaattctggggcagtcgctaaagaatataccgtcaaatatactggagaaaaagatttcttaggtaagggaaccattgtggtggttcaagatcaccctaaaaatatcacaatgaaaatcagtgacgctaacaaagcgctcaactaagtaattcacgaggaattcttatgacggacgaaaaaatcgaatggcgtaaagaagaagctggtttttcacttagaaaaaagcctcaaattttaaccatccctgctcaaaattattttagtatcaaaggtaacggtgatcccaatttacccgattttcagaagcgagttcaaacactttatcctttatcctatacaattcgcatgagtcaaaaaaatgattgggatattcctaactttaagttatacaccgtttatccgctccaaggatattggggaattcaacctcaatatttagatgcgccagtcatgcaaaaagaacatttcacatatacaatcagtattaaacaacctgattttgtgactgatgcaattgctgcagaagcgttagttcgggcaaaatctaaaatcgatgctgatttatttgaccaagtctttttcgaccatcaaccagaacaattagtagcgcagattttacatgtcggtgcgttcgacgatgaacctgaaagtttcgccaaattagagcaatttatcgatgaagctgggtacgtacgcagtgaaaaagaacataccgaaatctatatgaatgattttcggcgtgttgaagaagcccagcgtaaaacaattttacgagtagccattcaaaagaaataaaaaatagtaacgcacctcactataaagtaagggacgttactattttttaatttaaggcatgtcgtttccagcagcgtagtaaatgtcataccattcttgaccagtaagttcgacatcactaccagcagctgattctttaatatgctgaggattcatggttcccagtaatacttggaattgcgcaggatgtctcaaaatccacgcagttgcaatggcattcttagttacaccataaatatctgcaatttgtttcatcttcttatttaattctgggaatttaggattatcgataaatacaccatcaaagaaaccatattggtaaggtgaccaagcttgaattgtcatatcgtgtaatcttgcgtattccaaaatctggccatcatgatcaatactacgttcgtcgaacatgttagtatgcatgccaaaatcaatcattcctgtatgcataattccaaattgaagctgattaatttcaagtttttgcttagtgtacttttgaactaattcaacctgcattggattaaaattagaaaccccaaaatgacgtactttaccagcagcttgaagttcatcaaaagcttctgcgatttgtgctggttccattagtggatcaggtcgatgaagtaaaaaggcatctagatagtccacacccaaacgctgaagttcgccgtcgaccgcaccaatgatatgctctttactaaagttatagcgattgccataagggatgtcgccactattactattttcaattccacccttagattgaatgtacaaatcctcacgatttacactcgatagctttagtccttcacggaattttttgctggattcaccatgtccataaatatcagctgaatcaatataattaattcctatatcaaaagcagcctcaatggccgttgctgcgtctttatctgatagcgcattcattcgcatgatacctaaagcaacgttagaaacgcgcataccaccaatgttaatctttttcatagtacaagaacctccatccactatataataaattatagctccatgataacattaaacttcactatacaacattaaaaagaaagctacttttcatactatttttaaaattctcgttgtataatgtaacaataactagaaaaaagaaatggggaattatttttggatagcggtcagatagtctctaacctgattgtgatgctaattacttttatattagcttacttttttgttgcggcagaatttgctttagtgcaaacacggctcagtgccttagaagaggctgaaaaagaaacaacaagtgctcgtaaaaagaagaaatatcaactggcgatgcggatggttcgtaaacttaacgaatatttatccaccactcaggtaggtacttcgatctgtggtattatcttaggttggattggtgaatcaaccgttgaatattttgttgttgaagtttttggagcaactcacctaattaactcagcttctctgcatattgtgggagcagttgttggggttctattgttaacttacttagaagtggttattacagaaattgttccaaagaatattagtatcgatattccactaaaagttttaatgtgggtcgtaacacccctccattatttccataccaccttttatccattcgtttggttgcttaatgcttcggccaatggaattgtccgtttgctagggatgcaacccgccgatgaaagtgacgaaatattctctcaagcagaaattttaaatctttctcgaaatgccgttagtggcggtgaattggataaaaatgattatgtttacatgcaacgggcttttgattttaatgataaagtcgctaaagatatcatgattgaccgtacgcaactggttgtcttagatattaatagtaaagttgatgaagctctacgtcagtatcttcaaagccgtttcagtcgtttcccagtggtagccaataatgataaagataaaattcttggctatatttacaattacgatattattcgtcaaagccaagttgatggcgatatcaaagttagcaaattacttcgtaatatcattaccgttcctgaaacgctcgctttacaagatgttttagaacaaatgattcaaaaacaggtaccaatttcagtcgttgtggatgaatatggtggaaccagtggaattatcactgataaggatatttacgaagaagtcttcggcaacatcaatgatgaaatcgatgacgtttctggtgactatattcataaagaagaaaatggacattataaagttagcggtaaaatgaccgtttatgattttgaacgttactttggcattgatgttccagattttgaagaagaagacgtcgttactcttggtggttacgttattgatcacaaaccagatatcaaagttggtgaacacgtccgaattcaaaattatgatttcgaagttctcgataatgaaaatgcccatatcgattggttcttagttcacaaactaaaacctgaggaactcgctgatattcctcctgttgtcgcgataaccgagactttgtttgattaaataaaaagggaagtagtcctttaaaggctacttccttttttatttatttaaaatatgactccaaaaaattcccaatcccgttttccacattactatccgtaaccgcatcggcttcgtcttttaggatttgaggactattccccatcgcaacccccgtgccaacggctttaatcatttctaggtcattcatgtcatttccaaaagcaattgtgcgttcaagcgggatgccatatttatccataattgcccgtacagcagttgcttttgaaattcgcctaggaattaattccaagttgtttggtgaagacgacgataccttaagtaacccagttgcctccattttttcacgcgcttcatctagccgttccgacttggtcttatcaatggtaatcccattgataatttgactactaagttggtgtaaatgttccaggtctctaactttctcaaaacgtcggttaccagtcttatcagccataacccgaactcgagctaaacgactcaacatccacggcttttcgtgtgtgtaatacgtcatatctgttgtgaaaaagttagtcgaaagacctagttctgacgttatattataaatttccttaagtgcattccatcctaaatgctccttatgaaaatgatgtcctttttgatatacagatccatttgaagctataatttcaacttgatcgttgattttattgcgaattagttcagctagcgaaagcatccgtcccgtcgcaatatagaaaattacaccgcgttgttgtaatttttcgatggttctcttcgtctccggtaaaacgttctgatggttatcgattaaggttccatcaatatccataaacacaagatatggctccaaattcttcaccccttacattattaactatcattgtactactttttgttaccgtttccatatcacatcttacttttgcataacattatgagtttgcaactttaccgtggtatcattttaggtaagaggggcgtaaaatgttttttgaagtaaattctagacagggagtttttaacatggaaaatcagatttacattatatatatatcagttgctgggaatacccagtcatttgtagatgatctgacagattatgctgaaaagatgcatcaaaatgatactagtaatcctttaattattagcaaagaagttaccgatcagactgattttgcagatgaaactcaaccatattttgccttcgtccctacttatcttgatggtggaaatggtattgataatggcgttaaagaactgatgaccaatacgctcggcgaatatattgcttaccatgataaccgaaaattttgcttaggtgtaattggtagtggaaatcgtaactttaacgaacaatactgtttaacagctcgtcgctatgcccaagattacggttttgaaatgattgatgactacgaattacgaggtaatagcagcgattgtaaacggatttatgacaacatggccaaccgagttaaaaataatatttaaagcgaggagattgtatgacaaaaccaagacttttacctatttcatccggattgaattttcgtgaactaggcggatatacaaatttagatggtaaaactatcaagtggaataagttgattcgttctggaaaactaggaggtctagctgatgcagatatacgccttttagaaggttacaatgttaaatttgacgtcgatttccgttctcccgaagaaaaaagtaaatttcctgatcgtgtcccttcaggtgctgaatatgtttttgctcctgtttttcgagttgatgaaactcaaagcacaaaacaaactgatgaacttcagcgtaaaatgaatagcgatcctactagtggattagtcgaaatgcgccgtgtttatcgggatgtaattcgccaaagacattctcaaaaggcttatcgcaagttttttgatgtgttgcttgctaatagtgctgatgattctgcgctacttttccattgcacggctggtaaagaccgaacaggcatgggagcaatctttctattaagtgctttaaacgtggatgaagacactattcgtgctgactatctcttaactaatcgcgccactaaagcttatcaaaatggtgttgtgatggatcttaaactcaaaaataaaaactccgcctttattcaaagtgttaaagctcttcaatctgtaaatatttcttattataattccgccatggatgaaattcgtagactttctggatctatggataattatttaagagattatctaaagctaactgaacaagatattaccgatttgcgtaaaatttacttagaataaagatattttaaaactaacttaacaaagtttgtcactttcaatacacttcgttaacaaaaaattcacatttatgctttaatatgatttacatggatgaggaaagaaatttcctcattcgttaaacttttattctgattactcctccaaaaagtacagaatttagttttcaacaacctactccccaaaaagacgccttaatcggcgtctttttacttaccttcaaattttttattttccgaatggaattaaatcagactataatggtaatgatattaataaagggaggttttctttcttatgaaaccggaacgtattttaaatgtacctggtgcagtaaactttcgtgagctgggtggttatcaaactaaatttaatcagactattaaatggcaaaaattgctccgttcaggtgagctgagtcatttaactcctcgcactcaggccctattggctgattatggactcaaatatgatatcgaccttcgctcgccagctgaagcgtcctggagttccgataaaatcccagcccaaactatctatcgtttttatccagtttatcctatccaagataacgaaaaatctgatttaccccaaaataaacatttaaaatatcaagcttatgaacagtccttatatgatccatacctaacaatggcttttagtgaacactcgcggattgcttttcatcagatgtttgtcgatttattagctaataccaacgaaaaagaatcattacttttccactgtgcagctggtaaagatcgaacaggcatggccggtatgctgattctttcagcccttcaggtcccctaccaaactattcgtgaagactaccttctaactaatttggtatacagcaatcaagatcccgatgagcttcgccgccaaattactggtaaacatgtggataaacttatccaaaaaatgaatagtgtattctcagtgactgcttccagtctcgatcatacccatgatttaattcttgatcgttttggttcatttgatcattatttcaaggaagcactcgaattttcagatcaagatttagctgacttacgtcaaatttacttagaatagcataattccacagtttttgcgtaaacgttttcacaatgttaaaataggttaattacattcgaaaggaatgatattatgacaactccagcagaaaaaatgtggcatgattttactacaaaaaataaaattgaaggtaaaacttaccagacgcggtggtttggtcctcaagatcaaccagacgaaattaaccgtcttaacgctttgattttaagtggtaagaaacgttctacctcgaaaccacttgcctattattcagcagaacaagaggccgttcctcaggttggtgattatttcatccttttaaatggtgacatgaaaccaatcacaatcatccagacggtcgtctcggaattagtacctttccttcgaatctcaggtgagcatgcctataatgagggtgaaggcgacttatcgattgaagattggcgggcacgttcgttagctaaatttactaaactcatgcaaaaatatgatactcaatttacagaggataagccggtagtttccgaggtttttgaagtggtttattcagaaaaataaaaaagttatcctcagcggttaattccactgttggataactttcattttttgattttaattttatacttaccagctacttttctaagactgccagaggtttccacaatctttccttcacgtagctcttgccaggtagcgttcaaaactccaccaaacataactaccattgccgagaaatttagccagaacataatcgcaataaaggttcccaaagtcttataactggttactgaacgggcaaaaattcgtaagtagaatgagaaaaattgcgagataatcattgttccaatggttgcggcaattgatcctggaataacgtacttaaatttgattttagcattaggcaccaagtagtataacaacgctaatccaacgaataagcccacgatagttacaggccatttcaactgtccgatcaaatcaaacagatgcgttggtaaattcagaattggagttaaataactaatcaacgtttgtccaaaactaaagaggaataccaaaatccccataatagcaatgattattacggtcaaaacaaacgcgacaatccgattaacaatgggattttgatgtttagctacatcataagcccgattaattgtccgttgaaaagcagccacagcttggctagctgaatagattgtcaacaacaaactgaacgatagtaactcgccatttccactccccagaaaatctttaacaatgggctcggtaatgttgtaaatggtcaccggtaccactgtttcaatgtattctagcaccgtgttcactttgatatcaaacaatggtaataacgatcccatcaacattaccattggaaaaaatgaaagtagtaaataatacgctaaaacaatcgaattatttacaacttccgaatcgttgaaccgcttcagtaaagcacttaaaaacgtttttgtttttctaaaaactactttaaaatccatttgaattccccaattattttacaatatgtttgcttaagtttaagtttctgcctgccaacatcgtgataatccaacctaaaattgtaatcacaaagaaaagtgaaaaagtagctcggtatcccacgagggttgataatttacctggtaatccgttactagtgtgactgttggttacattctgcaaaacaactgacaaaattgccaatatcatgcctgaggacatcaatttgaactgagccataaaaatatcggccatgttatttaaacgtgccgatttttgattttggctgagttcttgacccacctgcattaacaatccatgcccagcttcaattattatagttaaaacaataaataaaattaggtttaagtaagttgagaataaggatagacatccccatcccaccatcattaagctcattgccattctgacgttattgaccgattcgaatttgttaaaccatcgtttggtagcatgatgcattaaaatcatcacgacgatcgatggcatcaaggctaatccaataataatgactgaataatgtaatccttgacgcaaatataaaatcccgataatcattaacactactaaggaagcatctccaattccttggagtaatacagcccgcaagtatcgaacattgaataatcctttaaaatcaatcaacggattgggtacagataattcacgccacagataagttgcgattagaccaatacctatcaccaataagccccagctaaaccagctactcgtgatttgatctcccaaagtaactatccaaccaattaggaccataaaaccactcgaaagaactacgtttacccgttcaatattatatgtactgatttctaaatcgattttaatacttgacgcattgtggtaaatgatcagacttaaaacaattaagaaaatattgattaattgccagtttcccaataaaaaggatattccggttagaaataaggctaaaactagcgctactcctaacataacatctcccattttggttaaacccacatttttttctggtaaaattgtcgcaattaaactcggaagcattggtaatagaattccacaccccgtggtttgaataatccggcccagtaataaaataggcatattaaaagctatccctactaataaagagccaattataaaaatagctaaggataactttaacaactgaacgactgactttttttgcaaccaaactgggcccaatggatacattaaagctaaccaagccaaaggtaaaatattagtcagttgtacgacaacttcattatttccaaatgcttccacaattttagtgactgccaatgcggttgaaaactctccaatcagcatcacaatcattcctagaatcagaatgaaggcctcacgatattcaccttgcaccaattgatcaaactggtggcgaatcttattcatgtatacgccctcctcaaataagcttaattataattttattaattaaaaaaggtaaagtaaaggcgcaacgaaaacttttttcaaattcgattgtggcacattgaaaccaaacttaaaaagtgtttcaattagttaataacacataggagaaataggatgatgaaaaagactattgatgaagcaattgaccatttacgtgataatcatatacggattactcctcaacgtcggttagtactggaatatttgattgaaaaaagaaatcatccaactgtggaaactatttttaaagcggtcaacgccaaagaacctagcttaagtttagccactgtatataattcacttaaacttctggtagatcaaggtctagtcattgaattaactagtagtgaagatggaattcattacgactactatggccatcctcatttccacgtaatttgcgttaactgtggaaaaatcattgatgttgattatcctgaatacgcatctgatttagctaaaatcgaccgcattgctgctaaaaaaactggatacgacattattgccaatcatattgaagtcgaagggtattgccctgaatgtgcacaaaaaaaataggagtcggaaaaattccgattcctatttttattttctaaacttgagctgcggtaataattgctactttatagacatcttcttcactagctccacgagataaatcggaaaccggtgcattaagtccttgcaagattgggccaattgcttcaaaaccgcctagacgttgagcaatcttataaccaatgtttccagactgaagttcagggaagataaaaacgttcgcatgtcctgcaatttccgaatctggagccttacttgctccaacagctggaacaaaggctgcatcaaactgaagttcaccatcatatggggtctttggatcacgttcttgggcaaccttagtagcttcgcgaactttatctaccattggtccagccgctgagcctttagttgaaaagcttaacattgcaaccttagggtcgatgtcaaataggcgagcagtttctgcactttgaatcgcaatttcagccaatgtttctgcatcgggatcaatattaatagctgcatccccaaagacatagcgttcattttcgcgttgcatgataaatgctccactaattcgacgcattcctggtttagtcttgataatttgaagagcggggcgaactgtatcaccagtagcatgaactgctccagataccatggcatccgccttgcctaagtaaactagcatagttccgaagtaatttacatctttgagcatttcgataacctgttcttcggtatttttacccttacgacgttcaactaacttatcaatcatttccttttgatcggcttccggatattggctcggatcaataatttgcacattttcaaggtttaatccatgcttttcagcagtagctttaatatcagcttccactccgagtaagattgattgaactaagccatcatcagctaatcgaatagcggcagctaaaactcgaacatcttcaccttcgggaaatacaactgttctattttggcccttaatttttgacttcaaaccttcaaataaatccatgagttagtcccccattttcttaaacttttcaacatcgcgagcaatcgctaattcttcatcagttggaattaccatgacttggacagccgagtcttccgcactaatgaaacgttctccacgtttttcattaagcgcttggtcaagtttaacattgaaaattcctaatttagaagtaattttttcacgcattggaacactattttcaccaattcctgctgtaaatacaattccatctaaaccacccatttcagttgcataggaaccaatgtatttcacaatattattaacaaaaatatcgatggccatttgtgcacgatgttcacctttttcagcggcatcaattatatcacgcaaatcaggtgacattcctgatagtcctagcaaaccagacttcttattcaaaatagttaagatgtcttccggattagtaatattaagtttttgcattaagtaaactactaaagaggcatcaatatcaccagaacgggttgccatagtaatccctgctagaggtgtaaagcccattgatgtatcaaatgattttccatccttgatagctgtaattgaactaccagcccctaaatgtaaggtgataatttttagttcttctaatggcttgcccatcatcttagccgcacgatctgctacatattgatgactagtaccatgagcaccgtatttacgagccccatatttttcatagtattcataaggaatactgtaaagataatttttttcaggtagcgtttcatggaaagatgtatcaaaaactgccacactagtgatatctggtaaaaccttcttgaaagcacgaattcctgttgcgttggctggattatgcaaaggcgcatattcttttaagtcttcaatttgctttaagactttgtcatcaattaaagcagaatcttggaaaatttctccacccgcaactactcggtgtcctacaccggtaatttcactgtaatccttaataatgtctaattttaatagctcttttaagagtaaattaactgcttcttcatgatttttaattggttggtcaatttcaacttttttaccatcagtggtcttaatcgtgaagtttgatcctggaataccgatccgatcgacagttcctgatgaaataaccctttcttccggcatttcaaataatttaaacttaagggttgagcttcccgcattgattgcaattgtcttttccaacttaaatagctccttctctcataataatagcttattgtaacgtattatccgtttgtaagcttgtaaaattcatcgttagaatttttaaatattattatttattgatatttcaatgtattttggttttaaaatgtcgtaaaaactttttttaagcgtgacgttttagcttcaattatcccaccaacatactatttcataatatctctttgcgtaaacgttttcaactatcgacaaattttacattttgactgcaataaaaaaagcctaacacaaagactttatgttaggctgaatattttaaattatttgtttgaaagcttgctagcagctgcttcatcaataataacagtaacgttatcatggttttgaagaacactagctggtaagtcagttgtgacaggaccttcgatcatacctttgattgcatcagctttgtcttcgccgtaagcttcgatcaaaatatgcttactcttcataattgaagcaagtcccattgaaatagcataacgtggaacgtcttcttcatgttcgaagaaacgagcgttagcatcaattgttgattgagttagtgacactttgtgagttgtactgtctgcaggtgtacctggttcgttaaaaccaatgtgaccattacgtccgataccaaggatttgtaaatcaattgggttatcttcgataatttggtcatagtgcttggcttcggcttcaagatctgctgcacgaccatttggtaagtatgagtgcttgaatggtttagcattgaagaggttttcgtgcataaagtaatcataactttggtcactatcttctggcaaaccaacatattcatctaaattgattgagattgagtccgtaaaatctagatcactcttaataatttcttgataagtggtaatcggtgtactaccagtagctaacccaaatgttgttgctccatttttctttgcatcagcaaatagtttgtatccttcttttccgccttctacgttatctttaacaataataaccttcatgatcaaatctcctttttcgtttttggtatagtccaattataaaatggtctaaaccaaaatgcaaggatttatcctaaaaaattaaaaataactttctctttacttatttagaatttaagatatactgattttgtaacaggggtgctgggctttacctggctgagattaaaactaaatggtttttgaccctcgaacctgatatggataatgccagcgcaggaagactcaattgtaatattagaatgattattttctaacacaagatgcattgaagctggctttttaagccggcttttttgtacctaaattttaaaaatggaggaatttatttatgaacacaagtgtcgcaattcaagtccttcctataatggaagacgaaaagaagctagtcgccgccgtcgaccaagctatcaaatatataaaatctaccggtgttaattatcaagtaggtgcttttgaaaccacccttgagggcgactatgatcaattgatggaaatcgttaagaatattactaaaataactgctgacgctggcgctccgcaagtaatgtcttatgtaaagattaattacaaaccagaaggacaggttcttggcattcatgaaaaaactgacaaataccagcattaattttctacctatcgtagctgttttattaatcttagccatttggcaagcaattagtttcttccagattatccctgaattcctgttaccatccccactttcggttttagaagtttttaaaagtgactattccgccttattttcaaactcattagttactctgatcgaagcattttggggactatgctttggagtgcttttaggggttggattagccttaatcatggatttattccatcccatttataaagcgctttacccgttgctagtgattactcaaaccatccccaccgtcgcgattgcacctttattaatcctttggttcggttatggcattttgccaaaagtagttttagtagttgctactactttcttcccaattgcagtcggcatgctagatgcttttcgttcaactgataaagatctcattaccttgatgcgtactttaggggctaatacacctaaaatttatttttacatcaagtttcccgatgcaattgattcattttttgctagcttaaaaatttccgtttcatattcattagtaggcgccgtagtttcagaatgggtcggcggtttcaatggtttaggggtttacatgacccgtgtcatgaaggcctatgcttacgacaaaatgtttgcggtaatctttttaatttcaattttaagtttggccttaattttacttgttaactggattcagtatcttattaccccatggaggagaactaatcatgctcaagcataaaaaaatttttagtctaatcgtccttttacctatttttacgctattactcactgcctgtggaaaatcaaattcagcggctaaaactcaaaccattacggttgccttagattggacgcccaatactaaccatacaggcctctatgttgcccaagaaaaaggctacttcaaaaaacatcatctaaaagtaaagtttgttcagccttctaaagatagtgccgaacaaatcgtagctagtggcaaagctcaaattgggatttctggtcaagattctttagctagtgcaattggcaaaaagaatccccttcccctcactgccatgggagcaattcttcaacataatacttcaggaattatgtcgcgtaaggctgatggaatcactagccctaaaaaaatgcaaggctatcgctatgcaacctggaatactcctacagaactagcaaccatcaaacaagtggttaaagatgatggtggtgatttttctaaggtaaaaacggtccctaacaatattactgatgaagtcgctggtctcaaatccaaggctgctgatgcaatctggattttctacggctgggcaggtattaacgccgaaattaaaaactatccagttaattactttagttttagatctattaatcctgtgtttgattactacaccccgctcattattgggaacaatagtttcttgaagcaaaatccaaaggctgctaaagcattcatggctgcagccaccgaaggttatcaatatgccgctaaaaatcctaaagcttctgctgatttattaatgaaggccgttccagaacttaagagtaatcagaagttaatttacaagagtcaaaattacttatctaaatactacttaactaaagacggccaatttggaaaaattgacgctatgcgctggaataacttttacaagtggcttaatgatcataaacttgttgaacaaaaactcgctaaaaatcaaggcttcactaatcaatacttaccaaaacagtaacttatcgaggaataattacaatgacagaattacttgtacaacatattaaccaaagtttcggtgacaaggaaattctccatgatgtttctttatcagtaaaaccaaacgaaattgtatcaattctcggggtcagtgggattggtaaaaccaccctatttaacatcatagctggtattaatcaacccaagtctggcaatatcgtctttaacgatgaagatattactggacaagctggacacctaggctacatgctgcaaaaagacttgctcctcccctttcgaacgattatgaataatgtaatcttgcctgatttagtcaaaggggttaaaaaaagcgcagccattgcccgtgccgaaccactttttgaattctttggcttaacgggttatgaaaataaatacccccatgaactttctggtggaatgaaacaacgtgcagccttgctaagaactttcctttcaactaaggacttaacccttttagacgaaccttttagtgcgctagatgaattaaccaaacgtggaatttatcagtggtacaccgatattagtcgtcaaatgcagaattcaaccttactaattacccatagcgttgatgaagccattactttatctgatcgtatttatatcctgagtggtaaaccagctaccatcagccatgaaattaaaattacgtctgccaaacgtaaacaggccgattttgaattaactgccgatttcattcactataaaaaagaaattttggatatattaaatccttaaattagagtccatttcggttgttgatagcgttaacatccgctatagttaaggtagcacaacaaggaggtggacttaatgagtgaaaccattttatttaatcccggagattcaattggtaacttccatgattataatgaagctgttcgtaagggacatctatacaaacaaaagcaacgtcaagacgatgatctagtaattgttaataatcctagtaaaaatgaggagtacgctattttctacgttaaggatcgtcatcccgaaaaaactgaaaacagcatcgaatacgatattagcaaaaagatttaaaatttcagaaaacaattaaaaagatggaatcatacctcgtttaaaatcgggcatgattccatctttttttaccaaactacacttaaatgttcacagttatgttctccagtttcaatttcatctaacatagcaatcgcataatccgcataactaatttcacttttaccgttagcatcactcattagcatttcatttcctaaaacgtaatgttccttcttgggaccatcagctttaaaatcagccgccggactaatataagtccaattcaatccattctgattctctaaaacttctagtcctcttcccatcatgattgaagtgggcttaaacacttctggaaatgtcggagtttcataaagatgggtaatatgatcatcgacgtataggcttcctgccccacccactacaaataatttaactgacgttcctgtcaaaatttttactaagtgctcaattgatgtcaaaaattgttcttcttttccttcggccgctctaaatgcatcaactactacatcgaaattttctaaatcagttgtagtcaaatcaaatagatctttttgtaaaattgaaacatccattttaactcggtctggatgacggacaatggcggtcacttcgtgcccacgctgaactgcttctttagtaatcaatgcgccggctttgccacttgccgcaataatcccaatcttcatgaaacatcacctcacctaattatttatacccccagaataaacgagttattaatcgtaagcaaataaaaagccgtaaccccaaattgagttacgactttatgattaattttttcttggataagttaaacgaattaaactactattcattgctggaattaagaagactagtataaccagaccactaattaccccaacagcaacttgtgtcaaggtcagaactcctgctggaattaaggcagcaaatgttccccctaggataattgcagctgaaattaccacggttccaataattcctgctgatttaacaattcgatctccagcatcctcgttaccaaattcacggtacttcatcattaagaagatactgtaatctactccaagggcaaccaacattacaaaggtgaagaaaggtacattccatcctaatagattttccccaaggaatgtactactaataaagcgtgtaattcctagtccacctacgtatgctagtagcaatgaagcaatgatatagaacggttgtaagatagagcgcgttactaacatcaatgcaagcgtaatgccaactaacataattactgcactacgtaagaaatcttgattagcaatacttgatgtatcagaagtttcagaagtctgaccgccaatcgaaacggaagctttcttcaatgaagttcccttgatattgttgttaatcatcgtttgcagactttcaacttttttaatcgacttagcagttaatggatctgaatctaagaccaccgtgatcttagcggcctttttatttgaagataagtagacatcttctgaatctttaaatgtatcactttctaacactgctttaggcacaaataatgtgttagatgcagatgaatcttgaagttctttcaagtaatcattggattcagatagcccgtcatttagtttaccaacgctgccaccagcggttgccattttttgttgttgtcccttaagttcatttccaagagtttgagcatcattaccgattgcttgggtataagtggcaattgcttgaaggcgagtttgcattgaacttactgaagccatttcttggctagctgctccagaaagaatcgtcatttgtgtttgtgataatggttgaccagccgctgccatcttttgttgtaaggccgtcatcaattgttgaccacttacagagctaccactagttgattggatactcttcaactcttgcccaattaaggtcgctttagcaccgatatcttcaagttgactagcatcaaaatctccaccagttaaacctttttgaagttcttttaagcccgcttgagccttgcttgtttgggaagtcaacgtcttcaattgatcattaacataaagctgatctaacttatcgccacctggttgagtaactgatgcaaccgtcttgattccatcaatacctttaatttggttggttaagttatcaataacccttaaatcactttcattatcaagcttgtgattgctcttgatatagatggtagtaggttccgccgttcctttgctaaagtgcttttgcaccgtcttaaatccttgcttagcagaataattagctggtagttcaacgactgtatcataattaagtttattgttataagttaacagcattggaattgctaaaattacgatgatgcctaaagcaatcaatggatttttagctgagtgtcctgaaagccaatcccacaacttactgtggtttgattcttttgaattatgactaggccagaataccttattcccgagtagtgacataaagaaggggttaacggtcaataatgctagtagtaaaatagcaaccccaattccaacccccgttgccgaacggtaaatggagaacttagccaatgctaaagtcaagaatcctaatagaacggtacttcctgaataaagaatcgtttttcctgccaccttaagtgaatgcttcgtggcagtttctttatccatcccctcaatcaaatcattcttgaattggttatagagtaagatattgtaatctgtcccgattccaaacataacaacgaccatgaaaacttgggtaaagtttgaaatcgtaaatcctgtatatttagctaaattcatcactgctgataaagcaacgatgaaagatagtccaacagttcctaaagaaattaaaggaacaattggggaacggaagactagaattagcacaatcaaaatgaagacgatggcaataacttcagtctttttaagaccctcttcaatggctaccgagaaatcatcatttaagatatcactaccagttacgtaagttttcactccgctcgtcttaacttctttaaccagcttttgattcatcttacgcactgaatcccgcttacctacatctagttgcactatctgggttgatttatcttttgaaattaattgcttcttagttgcctcactatcgttaggagcagtaactcctttaatatcatacttagatttattatctttgattttatcaatagtgtcattgatacgatctttttgcttatgggttaaggcttggtcaccattattaaagaccaaaacgacctggcgcgtattgctaattttgtggccccaatctttttggatggttttagcaacttggcttttagccgtatccggaattttggtttgacctttttcagctactaagctagaaatattaggtaacattacgattcctaaaatcaaaacgataatccaagtcacaaacttggcaatgttttgtttgatatacttactcatactcttctctcctatctataattaatcaattcactcttctcttaatgcttatttccctagtaactcatcaacatattccatcgcttctctcttagacaatggatgattctcgatgaaaatccacttaagtaccaacaaaatcgtattactataatgctccgctactaattctagtggtactttcgaagtttgattttttagatgttgctttaaaatcgtaatagcctcgtttttaaagtactcataaatgctgctcacgatcgaactattattagcattatgctttgctaattgagttaatagttcccgatgctgatccatggcctcaaagatttgacccaatacatattcttgaagatcttcgtcagcaacgtcatgatactgctcaatattgctttcttctttgaataataaccaacaataattcaataaatcttttttatcttcaaaatagttatagaaagttgcccgcgggaaattactaatcttacaaatttcattaatgctaatatcgtcatacgatttttccgctagtagcttatacatcgcatccgaaaatgctcttaaagttctttgcgctcctttggttgattttttcgtcaaatcatatttcatttattccctccaaaaatgtttttctcgataaactattctatctccacatatttatttttgcaacagtttaaatttagacatgtgtaaaaatacgttttcatacaaaaaagttacgataaaattaattatcgtaactctgccttggtatcattcatgtaattctaaaggtaacccatctggatcgaagaaaaacgtcatcttttgctgattcaattcatcccgccgaatatcttcaactttaatcccgacggaacgtaaatagtctacatctttttcgatgttatccgtagcaaacgaaatgtggcgtagccccgctgcttcaggatatgaaacccgctgaggagcgtctggtttgataaaaatttcaaacatcaaatctccatattttaaatctagttttacgtcgtttcgatctacgcgttccgtttctgcaactacttccatccctaatttatgaacataaaattctttagctaaaacgtagtccgtacaaataattgcgatatgattaacagccctaacttccatctggttcctccccaaaacttgtttccttcattttagcctgaagggctagctagaacaactgatttaatttaccgaaccaaatcctgagcacaatatttaacttctgttttaaattaaggtaatatcaaatcgtaggagctcagtgtttgttttacgcataggaggaattttattatgaaaattaatattacagagaatgcaaaagattatttattaaagaaagatatcgacggtaagcatatcttcttagcacttgatgatggttctagtaaattttcaaaattaggtggatcatgtgctattggtaataaattccaactagttatctcatctgttcctgatcaagcttacacggatacaattgaaaacgatgcggatcttaatcttactactggtaaagaagaggctaattatttaggtaatgggctaaaattagattataaaatgggactgcttaaactcagtgatgatagtagcatcttagatggtgccgttactgttcaaaattacgaaccaacagatgcccaaactaaggacgaactcgctaaagatatgaaagatatcggtaataaaatttgctaataaaaataaagaaccttaacttctttttctgaagttaaggttcttttttatgctgctctaaacatcatattgagtttctttaattccatcattcattaaatcatatggattactcatttcctctgcgttccattctgaaacacccacaaccattgaaatagcgagattcactaactctgggctttccttaatccgtttttcaaacgcatctttagcccgttgtccagcgatttttcctcctgtagcattagtgtacaaaagaatcgcccacgttggatcttcattttccaaaatataggtaatatcattatcacgcgtcgaacttttgattacctctgaagcaatttgtaataaaagctgaagttggcgatcactcatcattctccgtaaatcattaaaatatcttattttaataattagcgtggatacgggaatctcaaagcgtcgactagtttcaataaatactccggcatcttccacatatgcaaccatcgtccgcaaattagtttgttgatcaaaggcgccccgctctaccaaagccgcatgtaaatcactattcgccttttgcaatgcaatctgacttcgcgttgaaaggtacatggtcagtgaaattaataacggcatgattagccagaaaagcagcgaccactggatttcgtgattcaaaccaaaatattcatacaacataactacggtttgaaaagcaataaacaccatatttgctaacaagctgggaataattcccataaagtaagttacaattaaaattcccatggtgatgattaaataaattatattcacaacgatgttttgagaaagcatcatcaaaacggccgtaatactaagcattaatagaagtaggagtagcccaatatcttcatacaaatgctctttgctatttttgttttgcattcttacgacctccattcatcatggcttgctttctgaaaactaagtaaactccaaaaccgatgacaatcaaagctaaaaagacaattcccaaataaataattaattgactatttttactaatggtccgcttgtgttctaagtttcgatcaatgtatttgtttttcttgaagcggtaactatagtgggtgttattttgatctaccacaattgcatcgcctgtaaattgatcgatattcttcttaaaattaagctgtgtcgaagctagataactggcttccggagtagctcccgttaggactaaaatgccttttttactattttcaggggaacgaattagttgcgctgttccaatcgtcttaccgtaatcttcctcaatactgagcttttcattagaaacaaaccctcgatagtcatcagaatatttgaaatacaaatctttattcaaggatttaatcattgcattattagaaggagtcccaagtacaattaaattatcattaatcattgtatcttgattaggctgttcagtataaaatttaatttttccagtattactcttagcgtaagcgcccatcaagttaaaaatatttgttaaactcttgaagtctatcgcagttaattttttaggtataaccactgctaagttgttatatgtttggttcttcataaagattgtgggatagttggtaaagagtaaatcgttactcttttctgatttaaccttcatttcagaattcgtatctacttctgcccaaggggtttcagaattatctgaagtttcttgatccttcatttccaaatcaaaagctactcggacttcaaagctgtttcctaaggaagtccctttaggaacctccaaagtaacttcatctccattagctttagcagcggttaattttttacttcctaaggttgtatcattaacgtacaccgtcactaaggaacgtttgaagttaaggtttttgctatatcgaaaatgtaatctcaccttagaaccatctgcatttgtccgatcattaggtaaagttacaaaataactagtctctcgatgtcccgctcccttaatcttatcaatggcgttggttaattgatatttaccttcatcttggatttcggatgtaaaagtgttcgttagggaagatactatttccttacttttatctgtctgatgcattaattccgaattagcaaaaaactgagcagctttttttaataagccatctgttttggccgttacaattaaataatcaccttttttagtatagtgagttttaattaccgctcttttctcaacatctttttcgctaatttcctgcttcaaagctttaggaagattatcatatttagcgacatacaaaatataatcacctttagtagcatccatatttgtattttgaacaacattgatttgatcattatcagtagtaatcacacgtgattcacctgctaaggccgtcatactagctgttaatccccccttcgtcggttgatcaggcgttacaattttagaatgttggttggttactgtatcctcaccagaaaaatgatcatgaaaagaatggagcgtgttttctggatcttttagttcatatttgaaattcacattagaccctgacttaaccgttagccaattagctggagtttgtgctaaatcataattcttagcatcttttttatttaaaatttgtcctttaatttcaagtttattagtaccttgcaggagttctagcggaatctcaacagctttactctggaaaccactcttatgctctggacggaatgaatagaacttaacgccgttcattgataacgtaatatcagacgttgttttatcagctaactgcgaaacttgataattaaaattaaaggtagcttttttgacgttccaataatccatcttggtaaagtacatgctagttgctgttgatttaccagataaagttgttgtatcattttgaaaattttgagtataagttaggtcttcagcatgcacttgacccacgccgactaatgacattaataatatcgttaatgttaaaataattaatttacttataccgcttagttttataccattttgctcgtttatgaaagacttgttcacgaatataccccaccattccgtatgctgcgactgctagccacatttgactgtataccaaatacataaaaataatataaagaatattgctaaaacgcatttcacccttttcggttgtgaccgtgacaaaggtactgatgacaaacattattattccaaataaccacaaagcattactaaaaccttgtaaatctgaatgggccaacccagcgactgaaagaacaaaaactacatcagatagaatcaaagcggtcatcaataaaaagtacgttgacaagaaatagagtaagtcaaagcgaatgggacgtccggcctttttaaagagtaatttggcatttttaacgaccacgtaaatgtttcctttcacccagcgcgttcgctgatggaaccacacatctaaggtttgtggtccctgttcccaagtaaccgcacgtggctgaaacttaatttgatatcccatctggtagacccgaaaactaatttccgtatcttccgctaaggctttaacatcccaaccaccaattttttctaaaatttcgcgtctaataacataattggttcctggaatcgtacatagcctaaacagccgttgacgtcccgcttgagccatccattgaaacgaaagtgtttcaatattaataaatctggttaaaatagttgcttctttatttctagttctaaactttccaataaccgccgctaaacggtcatttcctaaaagttctgctactaaaagacgaagcgcaccacgttctggagtgttatctgcatcataaattgcaataacacttcctttggcttgcttcaaaccaatatttagggcattggacttgcctttgccccccgtaacattatctgtattaataactttcaaacgttcttcgccaaaatcattttggacttcttttaataactctgccgaattatcacttgaattgtcattaatcacaataatctcatagtgatcatgggggtagtcaaaactgagcaacgataaaacagttttaacaattacgattccttcattatgcgcgggtaccattaccgtcacaaagggaatcttttcaggaagttgcttatccggtttgggagcttcttggagataccacgtatatccagctaccgttaaaatcaaattaattattaacgttccccaaatggctatgatagctaccattaggaaaaaatccaaaattgtgatgattcattcctcctatctcttaaacatattcttgtaaatttttcttccaaaagcgataaaaatgattaagacggtaaagataatagcaaagaacacggtaataatttgcccttcaactctgaaaaagcctttaaatagcgccggcgtaggagttggcttatcagtattttccatatttgaattaacctcaacttccgtctccttaccattcaccaaatactgtccattttgaaaagcaagtgatgaacttgcaaaatcaatttttgaattaatggcttcatccggagcttgccattcaaagttcaacgcttgaatttgttcttttaaatttttcaacttaaccttactatcaggcatcttaaaagttagcgctgtgggcattgcaaatcgtacatctgcttggtgtttaatcttattaaaacttgaggctggtaatgctaaataacttcgactattggtaccgccttgattatcttgatcgagataaactacttttttattaggaagtagcatctgataattagctttttttaaagcactatttctcaagacttgatcctgattccaaaaaccttgggcactaatcccaactggataaacttgattttgtgccaaattaagtagatagttatcaaataattcactcaattctcctgcgttatccgcagtagctcccccgatcaccggagcttgtaagaaaatcacaccgcctcgatcttcaagtctacgtaaatacatggtaaaccttttatacgcgtgcatttctgtgtttttagctactgtggaagtgctgactgccaacggtatgccatgattttcacagaatacgcttaattgatctaacagctttagattactataaggtgaaacattcgtaatcgttaacaacggtttggtttcttcttgacgattaaataaaatagctatcatcttgctagctgtaattaatcccagtcctttattgttgaagaaaggcaagtaaccttgtttttgattaattaccccatacttataggattgaccttcattattttgcgtctttaacatgccgtaactctgtgcttgttttggaactccagttaaaacatccatgcgttccacaaatggcaacatttctgtactgctatcgtcacttaaaatgaattgttgttgataaatcgtctttagcttaacctgtaactgtttttgttcggttcgatctaagccttcaccaatatgaagtttaacaccgtcatattgattacgatctttaacgaaagttggattatccagtgacgcttgtttccagttaatcatggtaattaccccttgataactatggtttaactcacctttttgatattcactttctttaactgtcttaactttaagtcccatccctgctaacattcgctgtaaggtatcaatctttttttcaccttgttcgacagtattttgagagtcataaacgagcaaaacacgattatcatccctttcactaccatgtaccgtttgggtagcttgtactactccgccaagggtcatgaagaaaatcgttaaaaaaaacataattattttacgcatctccatcttcctcctgttcagttagccacaattgatgatttagaatatctgaaataaacattatgaaggtaaagtccaaactgagaggaaccatgaataaatgtttggctaaatcagcatcaccatcaccaataattgaaacaattggaacaaacacacaaatgctcatcaatcccagtattagaaaaaaacgtacaacgccaaataatcttccagctacaaagtcaatataagcactaactgcatatacagccacaaatgtgatagccaggagacacaaaaaggcatattttcccggaaaaaaagctcctgctagtgaactataaagtgtgaaaaaggtgctctgttgacccgcttttttcccagaatccttggtataatcgccgactgccttgacttgagtaaccataatatccttactagctacatctagtaaacgtaaaaattgatcagtatttctagcgtaatatttaataatccatgcaaaattatattttccaatcaaatgttttctaatgtagtgagaacttgggtcaacggtatcaaaagttttagcataatagtcttgctcccgcattaaggcaaattgctcactcagcccgcttttggcaatatttttactcggatctcctgtttccatcaaaaccccatgagaaaatgattgatattgattaacgtcgttgaattctttattgattaaactatacgtcagaactcccgctcccaaagtagcaacaacaccacccataacagctaatttcttagccttttttaaaccgggcaggaaaaagagccccactgacatgactccaaaacttagtgctaaaggagcattttgttgtttactagtaattaataccacaacactaataaagtaggttaacaacaatttccagcgtttagaataatctccacgggctaataaaatgagcgaccctaccacatacaagaatgaaattaacattcccggttcagcgaaaaaggaattaaaatacagaataaatgaagcatccgcaaagataagtactactagaattgcaatcacataacttcgtatacgtcgccaagttccggttaatgctttagttaacaggtagataccaggtaagaaagctacataatagacgatacctaagaagcgaatatcaaagtaacgatgactataaagtaacttatttagtattacagcggctttaacgaaaagcgcttgagatgaaaaaacagcaacgttattttcattaaaatactttaaaatcccaaacttagttaccacataaccaatatactgattatccttggttggtagtcgataaatcccgttacttaacattgcccgataaaaatctccattatcggcatagccattaatcggtggtataaagagaatgacagcacaaataatcgctgccaaagccgttgcaacggcagcaggtgatatatgtttttgaaataccttccaactgcttttaatcgaaaccatttcatcccatcctttagtattgcgatgttaacaatgccaataggttattaaatgagtaagcgtcattatcttttgtatcacctaatgccccataaatttttgaattcttatttcgaacctgatcatcccaaaccaagttcatggccttttgataatatttacgatcaccatttctggcgaaaatcattgctgctatagcataattacctgttgattggtcatggtcctcgattgctccagcagtagtgtaactgttatataacttcttattatcaatttgcatttttaaccagctgactgtttcaggtttcatcttaccaatttcagccaaatgcaggactgtaatcaaagcttctgaagtattcagatttttcgtgccatattggtttgttttccagttgtagctcggagcgtacaaaggaaaaatatctcccagatatcctttttcaactagctttaattgttctcgataatatccccgctcttttttagatacagattcaaagtactttagggtagccaaatcatagtaggctaaagaactttcgttactagcttttttagtacgtacatcataaaaattaagtacccgtgctttttgaatgcttgttgtttgtagcatagcaaaccgttcagccgcttcgtgtcgatattttttactattattattttgcgcataaatttgtaaagcacgaataattcttaaatcatccagcgtagcattcacatcggactttttcttagtcttaccatcgatgcgataactaaattgccgaccttgatcaaaatatttcttggtatttttgtagaactcccgaaaagccttattttgatgagtttgcgccaagtattctaaccataaacctgatgattcagataacatatcatgtcccgtggcattatcggattttttttgattattattaaaattcgtgtagataccagctttttgaaccattgaatcttttaaaaaattatgtaacaattcaatgttttgtttatttttatgatactgcgttgtaatggttaaatgatcggcgtctgctttaggaatcttagtttgtggttgtttttgtccacaaccaactaagattaagatgcatccaatcaacattcctaaagaaatgatttttcttgtcaaaattttctcctttgcaaaagtttcactattcaacaattattatactaataatacttataaaaaaaagcctatttatattgattgtctaaaaaaggcaagaccttgtcaattggaacatttaacaaaatcttacctttaatttggttatatatatttgtacataatatctattataaatttttgaatgcttggcgagcagcttgcaatccaaaaaccactgtttcggcgattgagttacctccgatacggttgtttccatgtaatccaccagcaacttccccaccggcatataatcctttgatgggtttaaaatttttatctaaaacttcggctttagcagacgttttgagtccacccatcgtatagtgaatagctggcgcaatatgaattgccatataaggaccttcttcaaaaccatcaaccaatcccatagttcttctgaatgcttcatccttacgcttagcaaccacatcactccactgttgcatcgtttcttttagattagcaactggtaatcccaaagtcttcgctaactcatcaatatgatcaccatgttgaactagaccgatgtgatcgtaaaaaccaatcgcactgactcttttagctaacgctgcattaaatatcagataggcatctggttgggtttgagcgttaattgcatccgttacaactttacgtgtgtctagctcgtttacaaatcgatgaccactttgattaactaaaattgcgccttccccacgtaccatttcaccaattaagaatgcatggtctccatcttggtaaacggtgggatgaacttgaatttggtccatatctaccaattgagcgcctaaattctccgctaattgtaatccatcgccagttgccccggggtgattagttgtcttgtagtgaacgagatcgggacgatattttttaattaaagcatcactagcagcaaaaccacccgtggctagaatgattgctgcactattaagtaaatggtttgagccttgggcgtcggtaaaatcaactttaaattgatgattatccccacgatcaatttccctaaccgttgctccacaaactactggaaccttttcttcagctaacttatttagtagttggtgaattaaatatccaccaattgcaggggcgctactagggcgatgagcccgcttcacactcattccaccagtcaaagtgatttcatctaaaacaacatcatgttcttttaaccactcaacggcagaatccgcatgacttgtaaaatatttcaacatttcgacatcattttgtttgccgccacctttatatgtatcttcataaaaggattcataactatcgataatcccttcatgcctttggattgctgtttcagcggcgttcatccctgaagatgcccgcatagagtttccaccaggcttctccatcttctctaggacaaccacttttttgcccaactcagtcagttctagagcactggttaaacccgtactcccagctccgataataattacatcatattggctacttaaatcatcaatacttgttggtttaaattctactcgttcagtcactactaaacctccgcttatttctcggagctaaactccgcaatgttgttaaagtgatattgatccattgctggaactaagccttgaataatgtcgtggcaagcatgtggattaccataatttgctgatccaacttgaacagcccctgctccagctaccattaattctaacgcatctttagcagaaaatacccctccaaccccaataattggtaaattagttacttcgcgtacttgatgaatcatgcgaactgcgatgggatgaatcgcttttccggaaagaccgcccgttccattggaaagacgtggctttctagtttctaaatcaatttccattcccattaaggtatttatcattactaagccatctgcaccgccccgttcagcagctaaagcaatgggaacaatttcagttactcccggggttaacttcatgaagacgggtttattaggaactaccgctttgatgcgccgggtcatatcttcaactacaactggatcagtaccaaatgctagaccacctttagcaacgttaggacatgaaatattaacttcaatgaacttcacattcggggcagtcgccatgcgtttagctacctcaacataatcatccggattagaaccagcaatacttccaacaatgggaagatccggataattttcagctaaccaaggaagttcgtaagctaaaacatgttcaataccaggattcttcaaaccgaccgcattcagccagcctccagtggtggccgcggtagttggccacggatggcctgcacgcggctccatagttgtcgacttaattacgaatgctcctagttcatttaaatcaatatttttagccatttgttgtccatatgcagccgtcccactagcattcataaccgggcttttcaacttgactccggcaattgtcgtttctaagcgatccatttgttttcctcctaaagatgtaatgttgtaaaagcttgtgattcaagcacttgtaaaatagcgtcaacggtatctaatgccgtaaaaagtggtactccataagttaatgcggtacttctaattttgattccatcggcagcactagtagtactgtctgaaatggtattaatcaccatttgaatgcgatgatcgtgaattcggtccacaatgttattttcttcagtcatcttaccaaccgtctcaactttcagaccatgtgctgcaagtgtttgagcagttcctttagtggcaaccaattgataacctagttcccaaaaacgtcgggcaaaatcgatggcttctcccttatcttcatctttaaccgtgattaagactttaccatggtctggcatgtgcattttagcgccttcaaacgctttatagagcgccttcgccatagtacggtcacttcccatgacttctcctgtagatttcatttcaggtcctaataaactgtctacgttatctaacttagtaaaggagaagactggtgctttcacatgaataatttcaccagctggatgcaacccgggcttcaaaccttgattgaccaaactttcacctaagatggcacgcgtagcaaggcgagccattggtaaatcagtaaccttactcataatcggaaccgtccgacttgcacgtgggttaacttcaatgacataagcttcgtcattatgaaccacgaattgaatattcatcaatccgatacattcgagcgattgagctaatttgatagaaactttcacaatttcatcttggaccttttgagaaagagtttgcgcaggataaaccgtcattgaatctcctgaatgtaccccagaacgttcgatatgctccataattcctggaatcacaacgttctcaccgtcactgattacatcaacttcacactctttaccaactaaatactgatcaaccaaaaccggatggttatgggaaaccttaacggcattcttcatgtaattttcaagttcttctttggcatgaacgatttccattgcccgtccacccagaacgtagctaggacggactaaaactggataaccgattgattctgcggcttcgattgctccagatgttgttgtcgccgtacgtccttgaggctgacgaataccattagcctgaattagcttattgaattcatcccgatcttcggcccgattaacgttttccacagttgtaccaaaaacttttattccccgttcggcgagtggttcggctaagttaatcgctgtttggccaccgaattgaacaattactccttccggcctttctaggtcaataacgttcatcacatcttccacagttaagggttcaaagtacaatttatcggacattgaaaaatcagttgagactgtttctggattgttattaactacgatggcttcataacccatctggcgaatggcttgaatcgaatgcactgtagcataatcaaattcaaccccttgtccaattcgaattgggcctgaacctagtactacaattgacttgcggttcgagacagtactttcattttctagctcgtaggtactgtagtaatacggagtttgagattcaaattcaccggcacaagtatcaatcattttataaacaggtgataatcccacttgttcacgatatgctcgtacttctttttcgttagttttccacattttgccaataacttcgtctgagaaaccattctttttagctaactcaagaacatcagcattaaatggcgtagcaattagttcctgttcgatttcgtagatgtgcaataatttatccaaatagtaaacgttgatcttagtcagatcagctaatttatccacagaatatccacgtttaattgcttcatacagataaaaaatccgatcatcacgcgcatggataatgccatcgactaagtctgcttcatttaaatcagcgagttcttcatcgccaatataattaatatctatatcaagagaacggattgctttttgggttgcttcctcaacgttgcgccctaccgccattacttcgcccgtagctttcatttgagtacccaaacgccgatctgcccgaacaaatttatcaaacggccaacgaggaatcttgcaaactacgtagtctaaggccggttcaaattcagctaaagtagtcccggtaactgggtttaaaatttcatctagggtcaatccaaccgcaatcttagcagcaactttagcaatcggataacctgtcgccttagaggccaaggcactcgaacggctaacccgaggattaacttcaatcacgtaataacgatcttgggctggatcaagagctaactgtacattacagcctccttcaatcttcaatgctcgaataatacttagtgaagcatcccgtagcatctgtacttcacgatctgttaacgtttgaacgggagcataaacgattgagtcaccagtatggattcctactggatcaaagttttccatgttacatactacgatggcattatcaacactatctcgcataacttcaaactcaatttcctttagtccggcgatactttgttcaattaaaacttgagtcactggtgaaagagttaaaccgttggcggtaatcttccgtagttcagcttcatcttgtgcaattccaccaccagttccacccatggtaaaagcaggacgtacaattactggataaccactttgatccgcaaagctaactgcttcttccaccgtcgttgcgattcctgaatcaggaactggttcattcaaatcgttcatcaaagctcggaagcgttcccggtcttcagcttgatcgatggcatctaatttcgtaccaagcagttcaatcccaagttcgtccagaattccagcttcagataattccattgccatgttcaatccttgttgaccacctagggttggcaaaatagcatctggtaattccttacgtaaaatttgcgaaacgaattgtaaggttaatggttcaatgtaaactttatcggcaatatccgtatcggtcatgattgttgctggattggaattaattaaaactgtttgatatccgagttcttttaaggaaagacaagcttgagttccagaataatcgaactcagccgcttgaccgataatgatgggtccagaaccgagtactaaaattttgttaatatcctctctcttaggcatgtttacttgtcctcctgagtttgtttagcttcatcaatcatttccataaaatcatcaaaaaggtagtccgcatcatgaggacccggtgcagcatctggatggaattgaacggaaaaagctttatattgtttatgtctgagtccttcaacggtttcgtcattaatttcttcgtgggtaatttcaaggtcagtgtttgcaatggaagcacgttcgaccgcataaccatggttttgggaagttaaatcaattcgtcccgttgctaagttgcgaactggatggttaaaaccacgatgtccaaattttatcttagttgtcttagcaccatttgctagggcaaaaagttggtgtcccatacaaatcccaaagactggaaccgcagcctccaccgtgcgaatcatttctagaacactttcattcattgattccggatcgccaggtccattggtaaacatcactccatctggattgcaggccaaaacttcttttgcagtagcatcatatggaagcaccattacgttgcagtcgcgacgagcaagttcacgtaggatggaatacttgagtccaaaatcaattactacgactttacgaccgttggctggattagggtatgggctatgagttgagctaatttcaatttggttttgtatcaaattagttgcatgaaattcttcaaacttagcgtctgaaatttcattaactaatgctgctttcatcgctccatgttcgcgaatatgtctagtaattgctcgcgtgtccactccactaataccgggcaaatcttgatatactaaaaattcttcaaaactcatattcatttgccaattactagctcgacgtgccacctcatggactaccactccaaagcaacttgacttaacggattctaaatcatctcgattaacgccataatttccaattaacggataggtaaacattaaaatttgcccattatatgattggtcggtaatcgattcttgatatcctgacatcccagtattaaaaactaactctccaatactttcacgattcgctccaatcgcctttccttcatatgtagtaccgtcttccaaaattaaataacgtttcattttaaattacccttcccgttgatatacaatttttccagcaaccatggtcagttgtgtctgtccataaaccttttgaccaataaacggagaattgattccctttgaagcaaaatctgcttctttaatttcatattcatcttcaacattcattaccgttaaatcagctacatctcccacttccaattgcccagctgccttgaggttaaaaatttcagctggttgaatgctcatccattccactagttgttctaccgtgcaaagtcccggtttaaccagcttagtgtagagtagtgggaaagctgtttctaaccctgtaattccaaaagaggcggtcttcatcgatccagccttatcttccaccgtgtgcggagcatgatccgttgcaatcataccaattgtgccatctagcagcccccctaagagtgcctgccgatcttccaaggttcgtagtggcggattcatcttcatcatggggttatccatcgaaatcatcgtttcatcaagaaataaatgatgaggtgcgacttctgcggtaacatggacgccgtctcgctgagcacggcgaattaattccacacttcgagcttttgaaacatgacaaacgtgataatgagcgcccgtgttacgcgcaatttcaaggccccgtgctaattgagctgtctctgccaattctgtaatacctggtaaacccaattttttggctaccgttccttgattcatcaccccgtgttgcattagcgattcatcttctacatgcgcagccagtggtagccccacttctttaatttgaagcattgcttgatacatagtttcggcagtttgaatgccgttaccatcgttactaaaagctaccgcaccagcttcttttaaagctttaaaatcaaccaattcttcgctggtccgttttttagtaatggacccgtattgtccgatatgaagactaccagcagttcgattatgttttaccatcgctgtcattttttcgggtgtatcagggacaggatcaacgttaggcatggttaatactgtcgtaaatccgcctttaactgctgcagcactgccactaactacatcttctttatccgtttgacccgggtctctaaaatgaacgtggatatccaccagtcctggcattaaaagttgcttttttacatcgatggtttgttcagcttcaacgttaatttcgggttgaatttgagtgattcggtcgttttccacaaggacgtcagctttttgcacttgatgactttttattactcgggcatttttaagtaaaactttcattaatgcaatcctcccttaatcaatcccttggcctctaatacgtccgttaaaattgccatgcgcatgtacattccattagtcatttgcttgaaaattcttgatttttctccatcaaccaagctgctttcgatttctgtaccacgattaactggagcgggatgcataatgatagcagttggttgcattcgatcggctcgttcgaaggttaatccatattcttggagatattcgtgtggttcaaatttaattgcggtatcttgagaaatacgttcattttgaattcggagtaacatcatgacgtccactttctctactaattcgtcaattggtaggaaggttccataagccttcaaatcttcggccatccatgcttcaggaccggcgaagtaaacttctgcacccagcttgtttaatagcattgcattggagcgagctactcgggaatgtgcgatgtctccggcaatcgcaatttttaaaccgtcaaagtggttaaattcttgataaatggtcatcatgtcgagtaatgattgtgaaggatgttgtccacttccatcgcctccgttgacaatactaatattcaaatcggcttctagcagttgtttataataatcgttttgcggatgacggatgactgcaatatccgtctgaattgcatcaattgtcttaaccgtatctaataagctttcccctttagtaactgaactagttttagcttcaaactcaaggagtcgcattcctagacgactttctgccatttcaaaactagtatgagttcgggtactattttcaaaaaataagttcattgcatagaccggtcgagtaagttcaattgtcttaccgttcttaaattcctcagctaaccgaatcttatgtaatacgtcctcttcactaaagctttctacagtggttaagtcatgcatattcattatttttcctcctaaattattataaaaaaagctactcaccaatcgaatcgtctcgctgggagtagcttaaaaagccgattcaattggttcctctcgggaaaccgatttaattgaaacaaagtgttattctattttttccaattccatggatcttgatgccactccttagccgaagctacttcttcagcggataaggcattgctagtttgaagataatccaccatttgattgtagttgagcaaactaagtagttcagtgttttgttctgcaaaattcttagttgaatccggcaaaccataactaaaaattgaagcaactccaatcacttgaatcttttctttacgaactgcttcaaccgctttaagtacgctgccacccgtcgaaatcaaatcatcgattaaaactacttggtcgtcagcttggagttgcccttcaatttgtttgccagctccatgatccttgggtttggagcgaacgtagattaatggtaagcctaattcttcagccacccatgcagcgtgcggaattcccgctgttgcgaccccaccgattactgtagcgttaggataagctcttttgatttctgcacttaatcctttagcaatatctgaacgtagaacagggttgctaatcgtcattcgtaaatcagtatagatgggtgatttcatcccactagcataagtaaacggtgcattgggtgaaatcgaaaccgcctttaaatcaagtagttgctggataattttgctacgaagttcgtcattcataatcaagaatcccctttttaatttttcgatatcgctatttgggtacaaaaaaagccaccaacaagttggtatgggccggcgctaaccgcgtccactccacctgttgatggcgactctgctagcttgttaacctctctggattaacttaaagcgactcgatttaattttcactaatcatactgagaataatcggaaatgtcaagatatttttaaagtatgtctatttgattcgaccaatttactttacatggttttatgcaatctcaccactaagcactcgatcgatcatatccaatacaccactatcattattatccagcggtgtaattaaatcagtagcatcgagtgcttcttgttctgcattcttcatcgcataacccaagcgggcatgttttaacatagcttcatcattttgggtatccccaaagaccattgtttcatccttcgaaactttccataattcttggagttgttggagaccgtatgctttagtgacatgtggcattgtaatatcaattccattgaaaccactcatcacacttcctaaatctcctccaaggtctcgtttcaacattgcggcttgttctcgaacatcttcgagattggtccaatgcgtatcaattttataaattggatccgtgatatctttaaaatgatcaacggctgtaagctggctgtagaaataagcactcgcggaccagtcggaaccactcttttccatattagtgaacgcccgatgttggctagaaagaataattttagcgtctttaaaggctggcgtagtcaataaatattctattgcatccctcaacaaagcgggtttcagcggattatcatccaaaatttttccctgttccatcgtcaaagccccatcttcagccacaaaagtcatgtcgccctttacgtcggcaaaaacctcttggcagtgggccatttgattaccactcgcaaccacaaatttaatgtgacgtcgattaagttcatcaagttgcgcttgaaaacgatcatgatcaaaatcacgttggtcattcaaaaaagttccatcaatatcacttgcaattaattgaatactcatcggttcctcctattaactaacgtccgcccgcaatccggtttaaattacttgaaagatgaatccaaaggttatccgcgtcagtaataaagtcttccttaaagtttttacctaatggttcgatacttccagttggcaaattgatcacatcataaacgactaattttccatcttctaacttacaggtaaagtagtgtccatcaagcgcttcatctaacaactgttgcgcgttatcgaccactgcttgttcgataagttgatcctcattagcctctttacccatttcttttagttgttccatcataatccgtagttctatcatgtcatgtgggatttgaataaatgccattttaatgtcctccattttatttactaaatgtaattttaccattaattttgagttagaatagtagttaaacaattgtgaagggattttttaattatgttattacaaagtattcaaggcgttttagtaatcattgtcatggttgccgttggttactacctcgcttcgctccattggttttctgaaagttccaaaaaattaatcgccaagattgtcacccaagtggccctcccgccatacatgattgtttcgattactaaagattttactaagagtgaattagttaaactgctccctaacctttggtatcctgtactatcaatgtttattttaatgggaatttcatggttggtggctcggattattcaagttgatcctaagagacatggactatttatgtcaatgttcttcaattccaataccgtttttgtaggtttaccgatcaatctagctatctttggtgataaaagtcttccctatgtcctcgtttattatatggcaaataccacaattttttggacactaggcgtctacttcattcaacgtgatagttccaatcacgttcaaatgaattttaaagatgctttacgaaagattttttccgctccgctattaggttttatgattggaattgtcctcattgtcttaaatatcaaactccctaattttctaatgtcgagttttaattatcttggcggattaaccatcccactctccatgttattcattggtatttctgtttatgacgctggtttgaaaaacatgcgtttccaaaaagataatttaggtgtcttatccggaagatttattttcgctccaatcatcatggctttacttgtattaccaagtcacatgcccatgatgatgaaagaagtatttattttacaatcttgcatgcctgtgatgaccaatgccccagtagttgcccaactttacgatgctgacgcagattttgcgtcaatcatggtaactgaaaccacgctgctttctctggtaatggtccccatcatgatgacgattttaagtcattaaaaaaacgaattgatgattctgctcctttttgcaaatccatcaattcgttttttatttttttagaagaataatttacttacaataattacgaaaattaataatacaactgaacctaagaaagcagccaaaaatgcaccttttccacgtttgaaaataacacggaagtttacggacattcccaaagcagccatggccattccgaggaagaggtatgcaaatttaactaaccagcctaatacagttgcgcctaaaggtacaaaagttccaattacactagctaaaataaagcctgccatgaaccatggaatcggtaatttcccacgaacaacgttttcgcgatctatatttgtacggctacggtgccaaaaaccaataattaacgcagcaggtgctagcagtaaaacacgagataacttagtaataatcgccgtatctaaactaaccgaaccacctgctccaccagtagcaaccgcatgggcaatttcatgaagtgatccaccagctaccaccccaaattgagttggagttaagtgaagcatgggtttcaatccaatttcaataaaagtaaataacgttcccaagatggcaaccgccgcaatggccattacctcattttcttgtttcaattcacgttggtcttcaggaacttgaatctgtggtgaaacccccattacggctgctgccccacaaataccagtaccactggcaactaggattgctagatcagaatccacaccaaatttacgagccaaggtatacacacctaaaattgtaaatgtaaccacgaaaatagctaatagaatggttttaacacccgcatcggctaaatcaaccaagtttaatttaaaacctaataaaataatacctaaacgcaaaaacttgtttgaaataaaaccagtaccttttttagaacgctcaactactgctgggctaacttgaacaaacatccctaacaccagcgaaattaccaatgctccaattaaactaaagtaaggcaattgcgccaatagcgatcctgctgttgcacaaagtaatgtaactaatatagctacccaaaagcttgaatcttttatcattcgagtcatctttcttctctcctatctcttaacttcacgtttaatatcgtatcaaaaatggtagataaaatataattatgttttataattggtttataaattaaacttataaggacaaaaaagatgctagataatcgttacgccacttttgcactactctgtaaaaataaatcatatactaaaactgcccgaacattattcatcacgcaacctgcagtttctcaacaaattaaaagcttagaggatgaactacaactaaaattagttgaataccaccatcctcgtttagaaatcaccagtgcaggtgaacaactggctcatttcattgaaactactcaacaccaagaagataaattattaacccaattacgccagccgatttcgacaaccaatcttaagtttggggtaacgcattcggttagcatccttatcgctccggccttaatccaaaattggcgaaaaaaatatcacaacattcaatgcatcgtttctaacacgcgtgatattttatctcaaatcgacgaaggtactttagactttgctgttttagaaggaaactttgataaacatgcatatggtagccaaatcgttacccacgaaaaatttgtagccgttacacgttcaagtaaccctctcgccaatcaaaaaaacttagcacttgaaaaagtactttcggaacctcttttacttcgtgaagaaggttcaggtacccgctcaatttttaccgattgggccagttcttttaacatctacaaggaagattttgcgcaagtgctagagttgggaagttccactggtattattaaactcctagaaacgaccggggtcagtttcatgtaccaatctctaatccaagcggaattagaatttaaaaaactcgcattactcaaaattcaaggtttagaccttacgcgtccgatttcattggtatatgctaaagatagcttcttcgaaaacgaatatcgacaacttttttaaactgggataaattcagcgttttgacaatataattcctaggtttattgtaaaaattgtggtacgattttaactatagatgaagagcttatggaggaattcattatgaatgatgtgacagaactagcagcaaaaatcatcaactgccaaaagaaaaatgatctaacagatgctgatgtagcatttggggcacatttgtcggttgaaaaactacaccgaatcaaggaaaattcctacaaaccaactgatgatgacttaaaacgcatcaatgattttatgaaacaacaacaaagataatcaaaaaataagggacgatggcattcatatcatgtcatcgtccctttttcattcagtttttttcaaatctagtgtacagtaaaggaaagattaaaaaacaaggagcccaattatgaataaatttgaactatatcatccaattcttaccgaacattttgccttagattggcttacacattcaaaagttcgtgacatttttgagttgcgtcacgatccagaaatcgctaaagctagtgatcgtgatattgatgcaactattgaggatacaactacctacgttaaccaaatgatgcgtttggtcatgaataatgaagcattaatttgggggattacggaccaaaatacccatgaattcttagggacattttgcatctgggactttgatcaagcacagaaatcagcttccgtacgttttgaaattcttcgaaatcaacaacataagggaattatgagtgaagttcttcggcggatgtccattttcagttttgaagaattaggactcgaaaagttacttgccactgccttgaaaaacaacaccattgctcgtactttacttgaacaagttggtttcagcgctgttgcttctcaaactgataatcaaaatattacccttgaacttaatcgtcactaatttgttggttatggaatagccctaattgctcaaaatcagccgttgaatcttgaaccgctaaactaggtttaggattagaaacggtttttttaggtgcttcaaattcggttggttcccgtaacattctatccatagttttatttagtaattgatccacaaaaacattaccttcatttgtagcatgtcccttagtccaacgatattctaggttgggcattcgttttagaatgctagccaccgcctgccaaagttctttattagctacaatttcaccgttagctttcttccaacctcgtcgttgccatccacttaaccaatttctttgaatggcatccaaaacatatttagaatcagctaccactaataccgctgctttttcaccatagcggtcgattactttttggagaccgttaattaaagccataatttccattcgattgttggtagctccgaattccccattggatccagagatactttcaccatctttttggattaagaaagcccacgcagctacatcttctttacggacatgccctccacggacattaccagtgttacgtgaaccgccatcagtgtaaagaataatggaaggggtcacagtcgatggagtctgcgttgatacttttctagtggcccttctagaagctgttgccatccattcctcagcttctgccttggtcaaaaaacttttatataccgctcctgcaaaaccatcaacctgttgtttggctgcatcccacgttaaataaagtcctggttttcgtcctttttttaccgcataaaattttcttttttttgccattaaatcacctcataaattaaaaaagaactatgtccaagggttgaatttttattttaatccaactgccttaaagcatagctcttattataaatgattattttcaaactttatacttatgcatttaaaatagcaataaaaccaataaatacaaagaatagtgcgtacattaatggatgaacttctttgccacgtttagcagcaatcatggcaatggggtaggtaataaatcctaatgcaatcccatctgaaatactatatgttaatggcattccaatgataattaagaaagctggaatagcaatttctaatttatcccaagcaatttcacgagtttgttgagccattaatacccccacaatcactaatgcaggtgcggtaacttgtgaagtaacgacggtcaacaatggtgagaagaagagtcctaataggaacataattcctgtcacaactacagtaaagccagaacgtccacctacagcaatcccagctgaagactcaacgaaagcccccactggagaagtacctaacaatgatccagtcaacattgaagctgaatcagacatcaatgccttccctacgcgcggcatcttattgtctttcataaatcctgcttgagtagccaaaccaaccaatgtgccggctgtatcaaagaacgttaccagcaagaaagtcaagactactacccaaagttggagagtattaatatccccaacatgtgaaatagctgtcaagaaagttggtttcaagcttggtgcagctgaaacaatgtgtgctggtgcatgaattaaaccagtcaataaaccaaagacggttgttaaaatcattcccacgaaaatagcccctggcaccttgcgaaccatcaagaaaattgtcacaaccaacccaaagacggtcaaccatgtggaaggaactaagaatgaacctaatccaaccatcgtagatttgttagcaaccacaattccaccttggctcaaacctagaaaagccacgaataatccaattcctgaagaaatagcatgcttcaaatcgactggaatcgcattaataattaattctcgtagtttaaaaacggtgattaaaacaaagattaaggaagctacgaaaacgcccgccaaggctgtttgccaaggcacatgcatcccaataaccacggaataagcgaagaatgcattaattcctaaagcaggtgctgaagcaattgggtaattagcgataatccccatcaggaaacaaccaatggcactagccaatgctgttgcggtgaagaccgctcccttatccatcccagatgctcctaaaacgttcggattaacgaacataatgtagaccattgaaatataagtagtaatcccagcaataatttctgttttatagtttgttttcaatttatcaaattgaaaatacttagcgatttgtttcaaaatcatttctcccttttagttcgaatctaaatcaaaaatagcaccaataaagtctacactaatttaaaatataagtaaagaacgccataaattgattatttaaacttttatagttcgtattttactttagaaataactaaaaaagacgactgctaattagcaatcgtctttttagtttgattttttaccaaatttgaactcgtttttcgggagcaagatacattccatcgccctcttttacatcaaaggtttcataaaattcttcaaaattttttacttggacgttcgcccgtaactttgcaggagcatggacatcaattgctaatagcaactcttctcgttgtttagtagccttagtgcgccaaattgtggcccagttagtaaaaaattcttctagattagcatctttagtagccttagctgcttccaacgctgctttaagtccaccatcatctgcaacattttcggtaacaaccaacttaccgtttacttttccacccgcaaatggaattccatcaaattcttttaccattgcttctgaaagttggtggaaatgtttcaaatcatcttctgtccaccaattgtccatgttaccaaattcatcaaataaagctccgttaggatcaaaagcatgtgaaatttcgtgcgccattactgcgccaattccaccataattttgactagcggtttgttctaaactgtaaaatggtgcttgtaaaatagcagctgggaaacagattaagttgccttctggtgaataataagcatttactgtatcagcactcatatgccattcactacggtcgacttccttaccatacttagcaagttgatcttctaagaaaattcgtgaaaattcgtgaacgttttccactaaacttccaccctcagcggctgttttagttttcaacttcttataaactgcttttaattcatctgggtaacctactaaaatcttcaacgaacgtaacttcgtaatcgctttagaacgggttgcatcccctaaccaagtattttctgctagtcgtttttcataaacatcaatcatcgaaaccaccatatcatgaacatcttttttagcagtttccccgaaatatttatgtccatagtattcaccaacgacttggctaaacgtgcgacgtgctaagtaaaatgcactcttttcttgtggcattgattcttgttgccctgataatgctcgcccaaaagtaccaccaatttggcggaattcttcactcaaatagcctgacaacgagcggaccatgttaacgtaggcccattttttataatcttcaaatgtatcggcgttaacaatttggtgcaagttttcgtagaatttaggttcagtgataattaatttttctggaacagttccaatcaatgcttggactaattttttaacatcaatctcttgaaccatgtcagcgaaatgatcaaactcccatggattataaagcttagctacatcgctaagttcttcagagtttttacggaaaggagcaatactagcatcgaaacgtttagctccatcaattatagcttgggcttcatcttcagacttacccaacttcgttagtaattgcatcatcatttgggtaaagacttgcatcaactgtggtccagacggattatcttggtcatagtaggttttatctgggaggattaaacttacaccaccagcccataaaacattgtgtttatctgctccattaccctttaaatcaggttcaatacctaaatctactggtaattctacgccattaaaaaataattcttttaagttggcatttacatcatcccaactctttaaatcttcaatttgttttaagtacggaagaagtggttttactccatcttcgtcccgttttttgaaatcagctgcaatttcataaaacttgataaattcttttaattctggcgtattaggttctttggcacctgaacgcatttctgcaaaatccttcatcaaattttcatccacgccatcaactaggtccataaatccacccgttgatgaatgatctgaggggatttctgcagttgctagccattcaccattcactgcatcataaaaatcgtctttaattgaacttggcattctaattcctcactttcaaaacttattaactctgtattatactcttatctacttctatgacaccgcgtcatgcatatacttagcaatatctttggaattcataccagcacttactgccacctgtaacttaatacgtgctttttgaccattgagaccttggcagaatacaacgcccattctctctaaatcaattccgccgcccacataatcgtagatgggttcggccaagccattgtaacaacgtgaaaccattacaaccgtaatatcattatcaattaatgcttgaatgggctcgactacttctactggtagatttccagctcctagcccttcaattacaatccctttggtccctgggcgattaataatttcaaatatttctttagggattcctgcgtaagctttaattaaatagactcctttttcaaggttatcaatatcacaaacatgctgattaactaaagcttgaaagaatcggatatcccgtttataaacaattccgagcggcccaaaagttggggttctaaacgtatctacattagtagtatgggttttcgtaacaaaacgggcagtatggatttcatcattcatgaccactaaaacccctttatcactggcttcatcggaagcagccgtcagaattgcactttgaaaattatacacgccatctgaccctagttcgttggaagagcgcatggcccccgttaacacaactgaaattttattttcgatcgttaaatctaaaaagtacgcagtttcttccaaggtatccgttccgtgcgtgattacaatgccatcacactcattgttatctagtgcctttttgaccctttttttaataattaacatatcatctggcgtaatgtgttctgaaggtttattcaaaatcacttcattaactaggtcaatatttttgttgataaattggctatctagtaatgggttttgttcattagttttaacagtatcattgctggcagacatcgaaatcgttccacctgtatgtaatgctagtattttcttcattatcaaattcctctttattattagttattcatatcatatcattttctttgctatttacagctcctcaaaatgcgttaaaataattctattaattcagaggacgttaatatgataaaacatagaaccagattccaaattttatatgatagttgtttggctatgattgcttttatttcattcctaatcgttgccgcttcgtttttttctaagagtattagtctgaaaaatacgaccattttaaatctaatgcatgtatttttaatcatctatgcggtcgacttttttgcaagaatgcctaaaaataaaaatgctcatcgttatctttttgacaatacttttgatttattatcgttaatcccactacatccggcttttgctatctttcgaattggtcgagttttcaaattaattcgcagccatcatttattatggcgttttggattagatggaaaattttctaagaccgttcatcggtttatctatacctcgggcttcttaaacctttttaccgtcagtatgattattttagttttaagctcgctcctttattctgtggtagaacatatttcatatccttcagccctatggtgggccattacgactgccaccactgttggttatggtgatatttcacctaccaccaacattggtaaatttattgccgcctttctaatgattggtggtgttgggttcattggtttgctcactagtacaattacaggattctttacttctgaagctgatacgcaggaagatgatatgaccaagcttttcaaaaaaatcgatcaacttgatcataaaatcgaccatctccagcgtcagctcaacctagaacgacgtaaaaatacgcgaaaaaaataaggattaacgttttgagacgaaattattcgcccagcgttaatccttatttttttaaattagctattattcttcgctacccattgccttagcaacaaaagcagcaattgcagcacctaataatggagccacaacgtaaacccagtagtgagccaaagctgaaccaccaactaagattgcaggaccaaaactacgagcagggttcaatgaaccgccagttaagttcaatgatgcaataatcatgaatgctagcgttaatccaataattaaaccagcaaagttagcattaccatactttttacttgtaactagcaagataacaagcacaaataggaatgttaccaaagtttcagttacgagtgctggaaatgctgagatttttgcaaaatcagtttgtccaagattgctagttgaagctcccatagcacttaggaaatacttaaccattcctgaagctagcacagcaccaataaattgtgaaataacataataaatagcatctgctccactgattcgcttattaatccacatacctaatgtgacagctgggttaaagtgtcctcctgaaattgcaccaacagagtaagccataatcgtaacagccaaaccaaaagctaatccaattcctaaaacgtcggctttaccaattgtaacagcggcagtaccaacaaaaacaagtacgaacgtaccaataatttctgaaacatatttcttcatcaataatctctcctatccacaggcaaaaaaccgtacgaaaattgtataccgctttaaccattttctcaaataaaatgtattaatcttgagcgtatctttttcaattaggtatacatttatgataaaatattgatataaacgtaatcaggaggggttcccatggcaaaatttgacgtacatattatcgaccatccaaccgcaaaggaaatgcttgtagaatttaaaagtcaacgacaagacaacgtgcctattcttgaaaaaccaggacattacattcttcctgattacaagttaacacgtcaacgtaaagctttaaaaatccgtaagcatacctacttaactaagaaattccgctcttacgtggcattagactcagcaaacggtcacatgctctggatgcgtaattttggtagtttatccgaagccattttttggctagaaactggtatgaagattggcgatactgatacagatgcgcgttattcgttcaaggagtggcaagaaaaacactttgaagacattgaaaaacttaaagatcaactacgagcaaaaactaaagctagacaagaaaacaaataacttagatgcaagagctgaggcaatttaatcaaccccaatcttgcattttttatacccaaaggagatttcatatgactacagaaaataaaatcttaagttcattatcatatttaagtatcttttttatgcccattctctttcccatcgtcgtatttgccttaacttctaacagtaatcaccctgaagctcatcgcaactccattactgctttttggcttcatttattaccaacaattttagttccagtggccttcttcttaggattattagcaactgggcaaagtttttctactgctaatttgagtgggtcttccctagtattatttggaatcgtcggtctcattggattattgattttaggaatgtttatttacaatctatatcgcggagtaaaggtctgggtggactaggattattgtccttcaaaaaaattatatgttttttttgacttatttgttgcgagcgcttacagaaggtgttaatatactaagtgaggaaaggaaaagttcctttctaacaaaaacttctcaagtgcctcggttcttaggctgtcagaatctagtgaaggggcaaatcagagtaactattgcaaatcgtttccatcatgggtgtacgatgtaaggttttgatgtttaaaagcatcgatgttttaaagtgattacacgcgatggtttcgttggtagttgcgacagccagcttctttaaatgtatgaagtgtaatgttcgaaaatttctacgtcatttaaacattgaatcaagtaggtgtgtccgatgacatgagtaagttgtctaaatgaagacaagattaattagtatcaaaaaaaattagttcaatggaggtctatcgtttcgaagaatatcttaatgaaactccaagaccgtctatttcaccgttagcctgaaacagtgtatacctcatcagatttagagtttgattgaacgatacaacagcagacgttatcaacagaagctcaggtaggttagaagcacgacggctgaacaatttaatacgtttttgtaaagttgaaggtgtaaagatcgtaaatttttccaataaagagattgtcgttagattgggacatctttcctcatgaagggattctagtgtgagaagtctagaatcctatttttgtgctctcaaataaaaaacaggaagctcaatcgcctcctgcaatattattgttccacttttcttcgtttacgccctcttccaaaggctaatattaaaatagtaatccctactgctaaataaccactccaccccagatggacgttattaaacattcctggaaatcctgacgtttctgcctcatttttataaataatatagaaagtatacccataagcaattagattaacccaactaccaattttaacaatccattgcgatctaaaccacgcacctaaaataattaatacggggcctattagtaacgcaagcaataccttttgttgccctaaagtttttaggatgctcaataatgtagttggagtgctatatcccgctactacggcagaagcaaacggtccaatataagtagaaatgattagcaatatcgcaccagcgattaaaagtttactacgaagtggatgtcccacctttttaggtttgggtttcacttccgcttgagctgaagtcgctggatcagtaaccatcgtttctgattctaaaacatcctcgggaacttcaaagtcttctgcttctatgtcggagtcacttctagcctcagcttctttacgatcttttttgtttttaagaccttgaatccaattagcaatcccatttttagctttctttattcccattcgcaactttaattccgcctgattatcagttggaccagcctttaaagcataaagataaccacacaaaataatcagaactaataaaccaattcctacaattctattgagccatactaagactactagagcaatcacaatcggtaaaagtgaaactaacggattatgtttcatccaaaaaataaaattcttaatttgcgaccaccactcagaatcggtatgggattgagtacgtgagtgactattggtttcagcttcttcagtttgaggttcttcttcaatttcttccgcttcttcactgcgttgtttgtacatttctgcccgcgttaatgttgaaggcccattttttgcttcattttcaagcatcaccccgcaattaggacaaaaattggcttttttaggcaattcttcgccacaattcaaacaatatttcattatccattcctcatttaagtctagttaaaattctttattttctactttaaaacatttttccacccgcttcaaagtaaccatagatttttagctatttaatagcaattctttatactttttaaacatttctattaaaatttaattcttttactaccaaaaaagacctcgaaaatagatttcgagatcttttaatgatcactaataaaaattagcgatatctaaaactattctttttcaatactaaaacggttgttgaatagcggactaacaggcttgttttcatgaatcaagcgaattgcttcaccaatcaatggaccaaccgaaatgctagtaattttgtcaatcttcttctcttctggaagttggatagaatccgttacaattaattccttaattggagaattttggattctttcaatagctggacctgaaagaacaggatgtgtacaacttgcgtatacttctgtagctccagcatccatcaaagcttgagctccaagtgtaatggttccagctgtatcaatcatatcatcaatcatgatacaacgtttgcccttaacttcaccaatgatattcataacttcagcaacattggcgcgtgggcgacgtttatcaataatagcgattggtgcttttaagaactcagctaacttacgagcacgagtaacaccaccatgatcaggtgatacaactacagtatcctgatcaagaccacgttcgatgaaatggtctgctaatagtggggcacccatcaaatgatctagaggaatatcgaagaaaccttggatttgtgctgcgtgaagatccaatgcaataatgcgtgtcgcacctgcacgttcaatcatgtttgcaactaatttagctgtaattggttcacgtgaacgcgccttacgatcttggcgagcataaccataataagggatcacaatgttgatagtcttagcactagcacgctttagagcatcaatcatgatcaacatttccatcaaattatcattaactggagcagatgtggactgaacaatatatacttcgtctccacgaatactctcttcaatattaattctaatctcaccgtctcggaatcggtccaccgacgttttcccgagttctacaccaactgccttagcaattttttctgctaagggcttgttcgaattcaaagcaaaaattttaagctttggatcggaataatgttcagacatgtttgcctccaaaagattataaaatattaagtttattcagtttttccatataatatcataattcattttgccccctaaaagcaagttacttacggttggtttccccatttttgtgttataaaattgcttattttaaaggaaatacaaccatcgatgttaactcagactatatttattgatttaagttaacgaatattgacaataatttattacacttgtatttacgtttacgtttatattacatgatataatgaaaagcatttaaaaccttatttgaatggctagcacattattcgttttttcaggaggaaccgattttatggaaaagaaatatattttatcaattgatgctggtacttctgtcgttaaaactgtgatatttaatcattcaagttctgaaataagtagtttttcaaaggaattaaaacaaaaaagcccttatcctggttggtatgaacaatctcctgatgaaatttgggataatgtacattctactattgctaatgctttaatcgtatcaggaattagtccacgcgaaattgcagctatcggtatcaccaatcaacgtgaaaccactattatttggaataaaaaaagtggtaaaccaatttataacgcgattatgtggcgatctcgtcagactagtgaaatcgctaataattggaacctatctaaatacaaagaaattataaaaaatcatacaggacttttaattgattcatacttttctgcatctaaaataagatggattttagataacgttgaaggtgctcaaaaacaagccgaaaatggcgagttgctgtttggaacacttgaaacctggttgctatggaaattgacccaaggtgaggttcacgcaaccgattatacgaatgcgagtagaaccatgctttttaacattcacaccctaaattgggatcaagaacttttaaacgccctaaatatccctctggccctaatgccagatgttcgttctaattcagaaatctatggttatacaaaaggggcatcttttttcaattattccatccccattgctggtatgattggagatcagcaaggtgctctagtaggtcaggttgcatttaatacaggcgatgtaagtgccacctatggaactggcgctttcatcactgctaatactggccaaaatgttattacttcaaaaaataatttattgactacaatctcttttggtatcaataaagagattcattatggtttagaagggaatatttttgttgctggaacagctattaattggttgcgtgatgggttagaaatgattaaaaaccccctcgattccgaaaaaatcgcgctacagtctaaagctaatgacaacttgtatgttgttacttcttttaatggcctaggggctccttactgggataatgctcagggttctgtgtttggaataactgataaaactaccaaaaacgattttgtcagagcaactttgcagtcgatcgcttatcgttctaaagacgttatttcaactatgcaagaagacatggaaacaccagttaaaattgtaaatgccgatggaagcgtctcgatgaacaattatttaatgcaattccaatctgatattcttggtacagaaattaaccgctcagaaacaactgatatcaaagccttaggagttgctttcttagctggtttagctgtaggcttttggaaagatttggctgaaattaaatctcaccgtcatcccattaccagattccaaccacatttcagtttaaagaaacgaaatgatttatatactgggtggaaaaatgccgttgctgcaactcgaatgttcaatcaaaattctgattaatttatatacaatttaaaagggaacgaaaaaccataattacgatttttcgttcccttttacaatcccgtttattttaataaaccatatttaactttaaaacgtcttataatctttcgccatgaattatagaataataatataaaaaacacgtttgataaggcgtgcatcaagtcaaaatatacggttccaaggatggttataaaaaaagaacttagactcaacggatgaatatatgcaattaaataccataaatccataatccaaccaaagataaatccccaaacaaatccaaatccactcattatgtatctgttttcgctaattctagtatcttttaacaatcccgctaccatccccatcatcccccaagcaaacatctgccatggcgtccaaggtccttgacctagaaacatgtttgatactaaagcagaagttgatccaacaataaaccctgcttctggccccatggccaccccagtcgttataattacaaaactagttggttggacactaggaatgattgaaaacggaactcgactaattgaagcaattgttgctaaaactgctaagaaaacaatttctctcgcttgaatatcgtaattttcaaaacgccaatagaatgggatgcaacttgctaaaagacatataaaactgaataacaagtaatgctgaccatttaatacgacaataaagcctaaaaaaactagaataattattacagcaattaaaaatgagagtccccgggtattcttagtcttcatagcttaaatccctccacgttagtgctttaggaatttgatatctaaccattcgattaattggggtagtataaaagaaattactagcaaaaaaatcataaggatttccttctgaaataatttgaccgtcaaaaagcattgcacatcgagtggcataagtcgcactaaaattcatatcatgactagtcataataattgtcatacctagattctcgaggttctgcaataattcccctaactctctttttctaaccggatctagccccttagttggttcgtctaaaactaatatttgtggttctgaaattaatactatccctagggctattaactgcttctctcctccactagtatcatgaggatttttaaattgcagttcttccagttttaacatttttagcatttttttcgaaacttgctctggatgttctctttctagttgtcgggctctttcaaaaaattcatcataaactcgatcataactaaaatgattttctggattttgagataaataacctacattttgataaaaatcagacgttttccatttgcttattttctttttcaaaattttgatggaaccacgccgctttttttcaagtttcattagacactttaatagggtagattttcctgttccatttcgaccaacaatcgataaccattctcctttattaagactcaaacttagatcttttaagattaaaggatcttgcttactatattgaaaatctaaatgtttaatttcaattgctggactactaatttgactatggaaagtccgttggtttaaattcagatgtactcctttatttagcagtacttttttaccctctacaaccgtcacgggaagatcatcattttcatctaaaatctgttcgttcaaaaaaaggcgcggaacttcaggaataaattcagctaatttctgatcttttatggatttttttagtccatcaacaatctgcccgtcaaaactaacttctccctcttctaaaattaatagcctcgtgctgagcggaagaagctcatccaattggtgttcattaatcatgattgttactccaagttcatcatgcactcgttgaagtaaattaataaattctttagtggcaattggatctaattgtgctgtcggttcgtcaagtaatagcaaatggggttgtaaaattaatactgctgcaaggttcactaactgtttttgtcccccagataattgattaacttgagtgtacaaaatatcctgaaagccaaaaaaactaaccatctcagcaatttttttctgaatactatcactgtcttccccgatattctctaacgagaaagctaattcttggataacagtatccattactaactgatcatctggattttgaaagaccatcccaattctccgagcactctcaattggagatatttcctttaagttttcattttcaaaaagaatgtctccatttctttctcctactggccacagttctttttttaactgtcttagaagtgtagtttttccacttccagaatcaccaatcactaatacaaattctccttgttcaacttcaaaattaatattatttaaactttgggagttagaaagtgcatacttaaaatttagattttttactttgagaaagtccaccataatgcctcccgtatttccataataattggcaatccacaaattatacttattacagtcaaagtcaacatttctatattagaagttacagaagtaacaatcaatttagggtaaattgttataattccaattttattaacgattgcaaatatcaaatataaaattcccgttgctaaaatcaatcctataatcccatcccgtttattaaacttatatctttgatagttcgatcgcttagtgcttccaaaacctcttgctgtcatcgaatcagctgtctgaaatgcttcataacacgaatctattaacaaaacttctaccaatcgcatcgtattaatagatttttctttaatactttttccttctaactgaataccacgagttttttgaatttgacttatatttttaaaccgatccaaaaataatggaacaaatctcataacaatcatcgtcaacaaggttaattggggaagaattttgccaaaaagaaacataaacttattgttactcataattttgttataagacgtgaaaattaaaattatattagctaaagaaaaagccatcaagactccataaatggttgcttccttcgtaattattaaaccgttgatagaatataaaacactacctccattgtgattagtaatcgggttaacaatcataataaaaagcatcattaaactggtaccttttaaagtttttaaagttgaatttaacccaaccgtcatactcgctaagaataacacgattacaaactccgttaataggattaatggtgaattaaaaaccatcgtcactacaactaatatcatatagtacagaaaaatagttgctggatttaacctttcaaattctattcgatgatttttctttaatttcgtatttctaaatatatatcccataataataactttctaatttaaatagatttgttatcttaacgttaccatttgcgttatcgctgtagtgataattttttctcaaaagatagtaataatttgtcatcatccaagctttgtattattttgtcatgatgctaaaataatacaagttaagcttaaaataatactattaaaagctgtttataacactaaattgctttgttagtagcaatttttagttttataattaacagaaaagaaatcgttttcaacaacaggaggataacatgttaactaccatagctccctcacaacaagatacttacattaagctagctaattctctcaatgctttttttgaaatcacacaaattgacgtgcttttcttcagtttttcaggcaccttaatctatcacggtgatattatcaccgataataaaactatccagcagactatggatcctgaccattttggtaagtcaatcatttttccaattgtattaaataatcaagtttggggatttacaatgtgtagttctgcaaaatcttccaaccatcgaattcaagtatctaaagaatatctctctaatttatttaacagtcatttttctgagcatgagaacgttcaaactatagtactggatcctcttacagatgatcaactcactaaaataaattacctaagtactattcttcaattaaaaacatctacagataatgtattgcccattgcaacagatactaatgatgaggaaaaaagtagtactgagcgttttgaagcgattaaaagtatcaaggaagctactcactatatttgcgaaaatttaaatagttctctaactttaaatagtgtagctgatcatgtatttttatctccttcctatctaagtcgaatttttaaaaaatacatgcatatcaattttattaattatattaaccatcaaaaaattgctcaggctcaaagagaactgatcttaactcgcaagccaattaatttaatttcaaacgttgccggtttttctcagacaagttactttactaagacattcaaaaaaattaccggtttaaccccctctgcatatcgaaaagaaaattctgaaattaaccgtatctacactcttcctcgaactttagaatggaaattaactgattcagtttttgatgtttcaaaaattttctttaaaaatcaaaatttagattactattatgaatcatctaatggctttttatatgtaaatagtattggcgatttaactgattctaatgaaaaaagtggctggatttttaccattgatggtaagcaaccaactacttcagcagatcagattcccattaaagatgtttctgttattcagtggatgtatgttgatttcaggtaacaaaaaagacgataattttatttatcgccttttttgttatggttttaagttaattaggtcgccaagctcaaactcatcgtcttgcaaatggtccacttcaaacccaaaagtattcaaaaattcttttctaaaaatatcaaagcccgttaaagagctgttaaaattatccttatcaatttcatgaaagagtttttctactttatgttgagttgacgcccgcaattcatatccatccgcacgtaatctacccttatcatcaaaaataggcttattaccgtaaatcatctcacgataaactcgatctttgtgcataataggaatttcatgtgtggcttcgtccatcataactttatacaaagctatcatatatttaggtaagattggtattacaacacttgctttagttgttactaccgtagaaacgcatataatgcctgttccacctatatcttttagtttatcggtaattcttcgcgctgagctttctgcttgtgtcttggcccttcctaacgtacccttatgataaatcgggtacgttaactcaggaccaatgtaagaatataaaactgttttgaatccttcgctcaatacacccgctgcttttagtgtatctacccatatttcccagtcttctccgcccatgacttttatagtgtcttgtatttcagatgagctagctggggtaactttttgtttgaagagcttttcattttctaaatcaatattttctccagttacggggttaccaatcggtttaagaaccgatctccaactttgctttccgtctggccccattcgtttaggggctgctaaactataaaccagcaaatcaatttcaccaccaaactcttgcttgatataatcaataacttgctttttcatatccatactataggcatcaccaataaagtttttagcgatcaatcctgcttgttcagcaaactctctaaagaaaatgttattgtaccatcctgctgaacctaaattatctaaatttttaggtccacgctcatatgagacatttatcgtgtctgcatcgctaccaaacgcagttgtgatcctagtagctaaaccataacttgaagaaccacctaatattaatactttcttaggtcctttatatttcccttttgattttacgtaattaatttgatttaaaacttcttgccgacagccatacggattaacagacctagctatattgccctcaatttttaagattggtttcacgaatccttctcctcatcgttattcaaaaattataaaaaagattaattctaatcaatagaattaatcttttaaggttattactagtttaactgattcatgagataaaaaatcaacttatgactgttaatttaaatatattttcctcaattctttacattcaacgtcagttaaaccaatctctgtttttaagtactgtgttattccaccatattgatattctaagataccaatgagttggtcaaaatactcgtttcttactgtagctaaatcccgaacagaactgataaaattgctacccaattgcatttttttggcttccgagattcgccactctactctagctactgaagcaacattagttaacatatagtccttgcgaatatcttccattcgaacccctaatgccgccaacaaaagtaatgcacacattcctgttcgatcttttccagccgaacaatggaacaaaattccttttttgtttccatacttaagtaaaatttcaaaaaaatgcctatatgctctttgtgcatgtcgatcgatggccaattttcggtaagaccgcattattttctggaatccaccatcactatttttggcatatagctgatatattttttccaacgaaatattgctttcggtttggtcttgactaaaaataggcaattttatatattctatctcttcagaaagccgatctggatagctgataacctccgattctgagcgtagatcaataactatgtcgatgccgtaatcaatcaatttttttaaatcttcatctaccaagtccgttaaatatcctgatcgaactaacttatgccatttaactgtactttgcccaattgtaggatacccacctaaatcacgaaagttaaatccgccagaaagacttaatattcttctactagtcattttcttcctacttctaagtattttctatagaaatttataaatctgtgctgatactccaatatcactcgccaaaacatcacttttattttttaaaacttggtcgccttgaacattatgcaaccaatcggggtcgataatcagcggtcttccaattccaactaaatcacccatcttaagagcagattcaattttgataggattacttatctctccagcaattatcaatggcacctttagtagtccccgaaaaatttcagctattgagtactttgtttcataagtttgggggcgtatgtcaaactgatggagtgatagactgatatagtctattcctaattcttccaaagtcttagctaaaatcagactttcttttaaagttaatccacccttttcaaattcttctggtgacatacggtatcccaatacaaaatcatttcctctaaattggctgatcgtattttttgtacgttgaatcaagatttttataaagcgaaggcggttttctaaagttccaccaaattgatctgaacgccggttagataaatttgacacaaattgttgtggcaaaaaactatttgccccatgaatttctattccgtcgaaacctgctgccatagctcttttggtggcatcctgatattgcttaataatcccataaatttcttgtctagttaatgcttgaggctcatcaactttcccataagtagctttaattgcactgggacccactacggggctccccaatgtagcctgcttattagtcattcgtcccgcatggactagttgaatgattgccttggtttgatttttatgaatggcttgggttaatttggttaacccctcaacatcttcatctctactaatactaattgagcctaatgcggtatttccagaattacttataaaagcagatccgataatatctaatccaacgctctttgagcggataccatgaaatttaatatcattttgactaactgttccatcaaatagagacattctcatatctaaaggagctaaagcaaacctacttttcaattctagatttttaatcatatatgaattaaaaccattcatagttgaaacatccattttaagctctccctaggttctagttatctgtggaatatcaaatcctaacaattcatgtaaagtactaacaactttgtttaaagcagactcaacctctgatacttcgcccacaattacaactgaaccactaaaacgatcaataaatcccaatgtaacgttactagatttagtagcaatatctcccgcaataattgatgcttcacttggagtaatggttagaattcccaaagcatttttaggagtttggactcctaatttttcataaatatcttctgtaggattagccacaatatgtgcaagtgtaatttgcttaccaggtacatattcttgaatcatcctagctttattttcgctcaattaaatcaactccgattaattaaatcctgcaactctcattacatcacgagcaatcatgatttcctcatccgtaggaattacagcaacttttactttgctatctttagcttcaatacttagtgcactttgcttatttttttcttcatcaatttttacgcccaagtatgctaactttttacaaatggcgcttcgcatggtccaagaatgctcaccaattccagctgtaaagattaatgtatctaagccgccgatatcactagcataagcaccaatataatgctgaatttgatgtacaaaaacttttaatgccatctccgcgcgagcgttaccattattagcagctttttcaacgtcgcgaacatcgcttgacacaccagataaacctaacaatccagattttttatttaacatttcaagtacttcgtgagaatccatccccaatttactttcaatgaatggcaaaatttctgggtcaatatctcctgatctacttcccattaccaacccagctaagggagtaaatcccatagaagtattaacagattttccatccttaatcgcacaaaggctactaccattccctagatgacaagaaatgacacgtctcgttttttcgttaccgaataattcgtttgcttttaacgaaacatattcatgcgatggaccatggaaaccatatctacgtattccatatttttcataatattcatacggaagagcatacatatatgattcttctggcatcgtttgatggaacgatgtgtcgaaaacagctacttctttagcagatggtaagagtttttcaaaatcttggataccaatcaagttcactggattatgaagaggtgataaaacactaagttcatcaatcctcttttttacatcttcatcaactaaaactgattctggatagtacgatccgccatgagaaacccgatgacctacaccagcaatttcatttttgttagcaataactccactagtcagtaacatgttaattacagctttaatagcttcatcatgatttttaattggtcttagggtttcagtagtcttatcgtttattttgtaattaaacgtactattttcaatcccaattcgatcaacttgtccactagctaaaacttgttcatctggcatcttatagagtttgaactttaatgaagaacttcctgagttaatagataatatttttttcgacatagctgttacctttctaaatagatcatctacttgatgattttatggtatatttctgataaatcttcatccgttggaacgattggatttccggggaatgtaccatctaacttagcagcagctacaatatgttcagtagcttctaaggcttcctttgtatcaatcccaaaagcagctaaagatgtaggacagttcatctgtctcatcatatttttaatttgtgattgaagtttacgtactgcaactcgatcacccatccctgaagatgctaaaccagattttctaactgcaatagcatattttttcatcgccagttcacaatgactagcattgtattcaacgatatatggtaataacattgcattagctaatccatgtggaatatggaatgtagcacctaattgatgagcaatggcgtgacaaatacccaatcctgcattattaaaagcgattcctgctgagcatgaggcttcgtgaacgacttttctagcttcttcattatcaccatgttggtaacattccactaaacaattgataataatatcaatacttttttctgccaaagcatctgttatcgtgttagcatccaaggccaccaatgcttctagaccatgcgttaagacatctaatccagagtaagccgtcacactattaggtgctgtcattactaggcgcggatcaagtaaagcaacgtctggtgttaaatagtcctccataattggagctttttgatgatgctctgtatcagaaatcactgccgtgttagtaacttcagaaccagtaccacttgtcgttggaatagcaataaaggtcttgatgcacttacctgaaattttttctccaaagaaacgaatggctttcccagtatcaattgctgatccaccaccaataccaatcatggttgtaggaacatctttcaaatattcttctacaccagccataatattttttaatggtggatctggctttacatctgaaaaaatagttactttgttactaccattaatattgtttttaatttcttctagagtagctgtcccaggcaaaaatgcatcacaaaccataaaaatattttcattctttaagtcgcttaatttttgaaggctgtcgttgcctgaatatatttttgttggaattgtaatttcttccatagttgtttaggcctcccatgaacgtaatgaaaatgcctctggtgaattcaaacgacgtctacgtgtaaaggttttagctgtagccgttccttcaccagttggagtagcaatagttagcgcagaagctcctgcatgggctccatttgctccgacccctgttccaacataggttgctccatttactacaaaaattgatgtattcatccgatgagccgcttgattgatatttggcaaattttcagaatgaatcgatgcagtatggtgtaagccgccttcagcttcaacagctgttgcaagtacgtctttaaatgtaggacatgaaacgattggaaccactggcattaacatttcagtcataaccaatggatgatctttaggcgtttccataatgattaattttggtgaaccattatatgaaataccagcttcatctagaatgaaagttgcatctttaccaacaaacttacggtctgggtccccattactaccaatggtcatattagcaattcgttcaatatctgaactgttagtaactaaataagcaccttcacgttgcattttttcgattaattcattttttacgcttgcttcaacaataacttctttttccgcagtacataaaatgttgttgtcaaaagatgcagaatcaacaatattatgagcagttaaatcaatatttgcagttgcgtcaaccattgctggtggattacctgctcctgcaccaacggctttcttaccactaatcattgcttgatgaacaactgctggaccaccagtaattgaaagcatcgcaatgtcaggatgttgcatcatttgttgaactgattcaattgaaggctcttcaattgaaacaaccaaattacgcataccagtagcttcgtatactaattcatttagtttttcaattgtccaacgagttacctttttagctccgggatgtgctccgaaatatactgtattaccaccagcaagcatcattaaagcgtttgcaattacggtttcagaaggatttgtacttgggcccacagcgccaataaccccaaaaggagcgtattcatacattactaatccaccatcaccagtttcagcttcaggttgaagcaattctgttcctggtgtgttgtataaagcattatttagcttagcgattttggcttcaacagtacccattcctgtttcttctttgatattcttagccattgtttcgatatatggtcgaaatccttcacggatagctgtaagtactttttctctaaaagcaattggcttatcgatataaatatcttcagcttctttagcagctgcgattgcttcatcaacagttttgaaaataccattatttcctgcatcagttgatactgtctttgtttctacactacttttctttagttcttcgcttagtattctgcgaatatcttcttcaaggttctgcatttccatttcacttactctcctttataaattcagccacagccgcttcacatattgcttggtcttcttcaatcaatccgccactaacaccaattgctccaacgatttttccgccaatttcaattggaattcctcctgggaatgatactaattttccatctagcattgtttccatctgatataatggcgctcctggctgaatgtctttgctaatgtctttagtaggttctttcattgcgatagctgaccatgcttttttaggagctagttcagaactaactaaatttgcattgggcatatgataaagcatttgaattaccgtagcagaatccataatgcacattgttacacctactccaagttcatttgctttttcaaccgcagcatcaaagactttttgcatcttatctcgttcaaacaaattagaggaatcaccaattttttgagagacaatttctttcacaattttatctatttgttcttcattcatagctattaccccttagataatttgttatatcttctaataacctcttttgttacgctcgctatttgattttcgtaatcctctgatctagccataatataaaagaaatctgataatctattaatatatttttccagtaccggacgaactttcacttcttttgaaaatctaacaaaatagcgttctgcccttcgataaaccgttctacagacatgtaattgtgaacctgcaagacttgctcccggcaaaataaaagtcgtaacctttggtaatttttcagtgtactcatcaatgatttgttcaagataatgaacatcattttcttcaatggttacactattttggatgaatttatctgtatcaagggtagctatttcaccttgcaagaaaaacattttatattcaatcttttttaatatctcttgattccttttgctaacgcacatcttatcagcgagactaacattggcatttaattcatcaaaggttccatacgtttcaactcttaaggaatccttggaaactcgcttcccatcgtaaagactagtggaacctttatcgccaccttttgtataaatcggcattatgttttatccctcccattatttgtcaaagctatctattattcctacaatggcacagtcactgacgtcattgatagctttatcagaatgatttgatttccttgcgcccgctccacgaaccaataatacatattcaccaatgccagcgccgactgaatcaactgcaacctcttctggacgagctggcttgccttgtgaatccacagcttggacaatcattaattttctaccaattaatgacttatctttctgtgtggaaacgacactccctactacttttgccatatacaattttcatcagtcctaacttgtaattttagattctttaaactactaatttcttcggcttcattggttaatttttgattattatccatcactacaattgaattatctggaattgcagccaaattactacgtgcaatgatttttgactggaaagagtaaattggattcttaccatcaactacgaacaggattggccaatctctaatcattactaatggaataaagttaattgaatacttactaatattcatttgaaaatcaacttcataatcaaggccttttaaaatccaagagatccaaggatttgcagtgtttaatcgatataattcggaaattaattcaatcgaaacttttttaataatcaaatttgcactattcacgaaaacatcatctgttggcaccgtaatatttttagagtaagtgacttcactggactgttcatttcttttttttaatctctcaataacttgagaaacaattggatccattaactcaccctccatttacaaactatttttttacgattttcccaacagtatcagccgttacgttagcagcattggcttcatcagtatcaatatgcatttctagtagaaaatcttttcttggacgacaaatcacatcatcaaatatcgttctacgatcctttgaattgatttccacagaaacggtatcacctaatttcacaccgaaacgttttgcgtcatccaaactcatgtgaatgtgtcgcttagcaacaattactccttggacttcaacttcgccgtctttagtaaccacttttacggttggagtattctctaagttaccagataaacgaataggcacatcaattcccaaagtaaaagcttctgatcttgcaatttcaatctgtgagtgcgcacgattaggtcctaaaattcgcacatgtttaatggttccatttggaccaactacatcagcaaattgatttgatgcaaactcctcatgttgatagagtggtttgaataccgtcattttttgacctggaaataacgtttcaaaatcttcatcggttaaatgaatatgatgatttgacaccccaattcgaatacgattaggatccatttcttcctcaataattttgcgaatcatttgtcttagttgatcttcattcataactccataccacccttaattagaactttatattatttttttgaaggcaaaatacgttctacttctgaatgtggacgtgggattacatacgaactaacaacttcgccaatgttttcagcagctgctacaccggcgtctactgaagctttaacagcaccaacatctccacggaccataattgtaactaagccgctaccaattttttcttgtccaaccatttctacgtttgctgctttaaccattgcgtctgctgcttcaattgatgctactaaaccttttgtttcgattaatcctaatgcgttattcataataaatttcctcctaatatagaaactcttttattttttattttttttattcttagtaactttgtttactttagcttccgtagtcttttcttctttatcttgttttacttcagctttttctgtatctttgtttttttcttctttaacctctttgttagccttattcaataaaaggtcggttttacctagcttatctattccctctgcaggattagcaaggactgttgaactcacatagtcttcgcccatagcttctttagcagttgcaattgagacaccaactgcagcgacatctccgacaactgtgactgtaacccaaccacttccacgagtgttttcaaccgatttaagctcaacgtctgctgttttcaacattttatcggctgccacaattgcatttgatagccctttcacttctatatatcctaatgttttcaataatttcaccacctagttcaactttttaaacggaactccttttaccaatcgtgccgcatttgctccaagtatccttaaattaactttattagacttatctgctacgaatagtggttcatcttcatgtaaatttttataatgaacaataactgatttgtcatcaaaaccaattccaacagaaagatgtgaagataatgccgcttgataagccctttcggttgctgaattaaattcaaatttctttactgatactggaatttcttcttcttcaaccccgttaaaaaaatcggataattcttttaagtcgtctgtatcattttttatcgcaacaacaatagtcggtttatccattcccatcaaatcacacccttaaatttctggcataagataaaattaatcctgttgcaactgcatttcgtggaccttcaatcgaacgaatatttccacgaccagcaaccaagttataatgtgataattcatccgtaaccagttgtggaatttcgaaatctaaagccgaacctccaacgataactacaaatgggatatccctgatattgcctgtcggactaacatgttttaaagcacgctgtgcatttttaacaaagactttcttttttgcactttgccgtacatgtttaattttctcgatactgatgttaccaggtactggttcatacccatcaggtttgataacaaccacccgtgcaaaaatatcagctggtaaaggcttttcaaaaaactgaactgttccatcttcatgacgaatctggaataagttttcaacttttgccaaaggatacttcttaatgtcttctgccagatatatatcatttaacccaagttctgaattaatgatcatcgtcgtcatatcacctgcacctgcaagatgaatggcaacaattttattgttctgatcgattattgaagcatcagttgagcctgctcctaaatccaaaatagcaattggtttggttgtacctggggtagttaatgcaccgagaatggctgcctcagcctctgctccaccaatttcaaccggtacattcatttcatcttgaattaaatcggcaattttttgcatttgcaagcggtctgatttaaccattgcggcaattcccacagcttgttcagtcgaaaattcgccggccaaaccaccttgaactttaattggaacagaagtatctaccgccaataaatcttgtatggcaatatccttattttgcttttcagttagctccgccattgtttgccggaccttttcaagcattccaccaacgttagttcctgcttcaccagtaatattggtaatttggtcaaagcccataattttgttcataatcgcgtcagcacctgccgaaacgtttacagaatcggttgtgtgatcgccggctatatttatgtttccagcaggtattacacgagccttaacatcaccagcaggagtttttataacaactgctgagcgatttccgattaaagctcttgaaaccggaacaatatttttagtttcatcggaattaagattaaataaggttgctattccataaggatttgacagttgtgaaatgaccttacctttatccgctacttccactgcggctagcattccaattggtattttttcaattaatgaaacttcatcaacaattggaatcttgtgattaagtcgattgttaatcaacaccccatcatcattttgaagaacagccgccgtaattttatatccagtttggacatacatatttattaattgagctgcatcggcaaagtctacctgtttggggacaattacaatgtaggcacgctgtctatcattttcctgaaccaacttcaacagatcaactgtgtaacctgacccaatccctacccctcctagagtattagggttgtgtccaatcattgtcgattctgtaataattgtttccgaaatagtttccatagcgacatctccaataaccggagttgcctcgttaattctaattaaatcaatcgagcttatatcaagtttggctttttttaaaacctgcataagcgatttcttaattccaattaaattttgcttagtcccttttattccagttgtttctgatattcccgaatcaataaattttatttctccagagtcggatacttcagcaagtgcaacttccgttgaagagtttcctatatcaacaccaatcacacgtttcataaacttacccctctaattatcacccttcagttttttacgggtttcgtaaaattcggctgcttcttcaaaccaaccagcacaaattttcgcattatatttatcccttagttctgaggcaatatccaataattcctgcttagttgaccggtaaggtctgagagcattgtacatttctaacagacgttcgtcaggaattacagttaattcagcagcacgttggaaattttgttgaatagaatcacgtcctgcatccacggctacttcaccttgtagacgtaaagtctctggtgtaattcttaaatcatttgatttaatattgtcattcaacaaattacttacattaatatcatccaattttttaccagaaggtgaatgaatcaattctggatgcttagaatatagtggataatctttagctgtgattttttcgtttgagttttgagacacttgggttgtagaagcggtatctacgttagtcgtactatctgaacccatctgactcataatttttgacactaagtcatctatttcgctcatgtgtttcccctcctaattgaagttaacttcaatttcttcagcaggcttacctggcactacttgtttagtttctttaatatgcattaaagctgagatggcttgatatgcaacacgcgccatttgatcattaacagttggaaccggacttggcgacatccctttagcgtattcagcagcatttttaccaattgcacgatatgtttcgagatccaatacaggggcctgagggaataattccaaattagataatggttcctgatctttttgatggataatagttgtgccttttgattgaattgcaattgcaattcctgaaccagacaatttgtcagcctctgaaccacagaatgaaacatcagaagtacgataaattttaatcactctagcttttaagccttcttcttcaataccagcaataatttatcttaaaatttccttgtgttccagaccagtcatatttttttctaaaacttcagcaaaagccggagcaacaccaatgacaacttcatcttttgagaatccttgtttagcaattcctacatgtttaaaccaatcaaccttgttttctgatactttatgagaaattgttgaacgatcttcagaaccagtatcactttcgtctaaagaagtgtgctcgtctttaaaagaaattgcggtatctaaagtttgttgttcggccataacttctttaataatttttcttaataagttttcatcaatagtttgggtcatttttttacctccttcgactaaaatttcatatttcctggatcaatagcgaatggtacattctttatacgttcccattcttctgtatcttcgtctaggcgataacctgttcctggcccttgataatcgtttgcgttattaacagccgaaatgatattccaatctttatcaaaaattgatgaagtttgaaggaaatcaccacaaactttttgtttttgcaaattaagtacagcttcagctacatccttatatccacggttataaagcgcttttataatatcaacagctgtgattccgcgatctaagagttcttgagctgatttcatatcttcaaccatgttacgatcaggcatgtcctttgaagtattagcataagttgctgcctctacttcttcatcggtaatctttggtaatccaagctcttcaaatactgcttgaagtgccttggcagccttgttacgtcccttgataacttcttcttcagaaacgggatggattccaccattaatcatcaaatcacgttccatgatgtaatagtcatcgtaatccatagcatctgtattagatccggcaaaagtattatcataatttggagttgatgaataacccgatgatacataatccgttcctgcaatgaattgacctaaaagtcgctctgttctacgaatatctgagtgagaaaaggcttgatcattaccagatgcgcattctaaatcaagcatcatacataataagttttcacccataactgaacgaatacctgaaggaacagcacctggaataccaatacaactaaccccaccattttgaagtccttgtacaccagaagctttagtaatgaaaatacaacgagattctagatataacattgatttaccttctgtatatcccatcatagcttcagaaccagaaccagaagtaaatctcatctttaatccacgtgatgcataacaagaagctaagaatcctttagaccatggcgtatcatcaccgtcagtaaatacacgatctgtaccatatacagaaattgtttctgcataacctgtaaatccacgcattcccaaacttaattccattgcttcctcaacagaacattgtgtaagtacacctggacgaccagtttgtgcaccaaccattaaagcgattgcatttaatggtgcgtaacgtgcaacagcagtagtagtctcttgttctggaaaacctcttaaggcagcatcggcagcatcagcagcgatttgaactggattatcacgaatgttagtaacgtgacattgagtagcaggcgtacgacgtggacgcattttttgcgttgccataatcatttcaccaaaattcaacttactaattacttcttcggccttagctggcgtcattgcagttgtaatttcaacaatatctttccgaggtacattaggatcaactagcatattggcaattttagttgaatccatcttcataactttctcggcattttcgagtttgataccatatttcgcgatatataagtcaatcaaatcaaaatctgcacgttttttttcatctagttcagttacaatgccattttcaattttgatacttggtttagggtcattaggacccatcattgctactaaaccttcatccggccactcacgaacaaatccatcttcatgaattggtcgattttctaattcttcaaatcttttttgtcttttcaaagtaaagcccctttccatttcctacttaatataagatggaaaatcattcttaggttctgcacctagttcagctaataactttaatcctactgcacgaccagccatcacagcttgacgaacagcaccagaatctccactaatatggagaataccttcattagaaaaactagttccatttccaggtgatgcaaatcctagaacttctacaccagcagtcttaattgctgtatctgccatcactacaccaatcccagatggtgcaccacaaattaatccgtaagcttttccgattggagctccaaaagccacattcgcggcactagaagcgctggcagtaaattgtaattcaagatgacctgcaggagaattgtaaacatcaccaaaagttcttgataaattatccaatgcgacaccaattgcttgacgaacatctgatggatcactaccaccaataatgattaacgagccgtgaccagctccacctttagtatctcgtggcaattcaatatccaacacttcagtgttagttgccttcacagcttcgtccattgccatgatttgtggaccagcaccggaacgtgaacttaacacaccgataacagaataatctttagtgcttacttgcaactgatctaacaacattacatcgatactagggatacacataccaatcgtatctccaatttcgctagatccaacaaattcaggcactgtactagttgaattaaaaaaattgttcatattcatccctccagatgaaacctgttaaaaattaataatctattttttaaatgtgattattttacttttggtaaaatattttcaacatctgcatggggacgtggaattacataacttgaaaggacttcaccaatgttttcagctgcagtaactcccgcatcaactgaggcctttacagctcctacatctccacgaaccatcactgtaactagtccatgaccaattttttcttgtccaactaaatcaacattagcagctttaaccattgcatcggctgcttcgattgatgctactaaaccttttgtttcaattaatcctagtgcttcatgctccatgagatattcctccgttttatttgtaatttccaattgatatggtcccaattgggcctgcttctagtataattgaaagcgttttcactttttggagtggttattttaagaaaaaaactgattaaaacacttatgagtaaaataattccaaaaatgacaaaattaaactattgtttttttgtccattaaaaaatgcccaatgaaataagaactttcattgggcattttattatttaactcttgtattttttagataggttgcaaattcatcaacattttcgtttgtaactgaggacaatgcaaagaccttaactgctcctgcacttcttaaacgtttttcggccatgtcaatttggctttggttagtgactaaatcaatttttgttacaaccccaataacaggacgtccaaacattgtactaaaagcttctggaaaaattaacctagaatcagtggcactctgcaatataacaatcattcctgcatccattgctgtagttgcaatgttagtatacattcgacggtgttcaatatattctcccggagtatcaattacattatcataaaactctattgtttgcgttttattatagtgcaattctatgttattaattctttgcaagagcgttgtttttccacaaccgatgggtccaataaacattggtcttttcatttaaatcattcctcaatttttaatatccgtctacaaatttccaatatagatgatcatctggcttcaaactcttcaaattagctgcttttactatatcgtcattgttattaatataatatttccatcctgtacctgagtgtatgtaattctcagaatattttccaattttatacacatagatagtagcaccgttttggtaaccaactttctttttagctaccttctttaacgcagtgaatgcattcaaatccttctgatagtcaatatccttatttaaaagtatcttatgtttttctttaggctgttttaaatcaacttcaatagtcactctcactttactacttggaactttagtatgaatttggctattcgttacattcgtattagttgattttgctttattagaatttccatatataccaaatattcctataccaatcccaattagtagacaaatccccaccatcaacgggaaaatcctatgcttcattgagcttctccaaaagtttagttaaattgatatactgtcttgcttgcgtattttccatttccatacgcgctaagacttacgagtacttgaccagctccaagtgaagcatcgtaagcacctttgattgatccatctttctttacaaaagataatgtattttgtagagttgaactttcttgtttttcattcaactttttaacattaatattcttgaaagtcttctttgaatttgataatgcaataataacttcagcgtttgtattagcatttgaagcacctgctactccaaaacctccatctttattaacattagctttcaagaaatcttgtccattattaattgcattttttacaatcttactcttattcttactcatttttagagcatttagagtcattgctgtggtatcaacatctacatcagctgctttaccatcgtatgcccaacccccattgtttttatagtttttattcttcttatttgcaactttaacttgttgcttggcaacattcttgctcaactttttaactgtgaacttagcgttcttaggtgctttgaaatttttgtttgatttcaaagctactaatacttgggcttgttcattaaccgttgcactcttacctagaaccgctttgctcttatatagagttgacactaaattcaacttttcattagaagtcttatatgcttttggattcaaacctaatgcttgtaaaccaatgatggcattagctaactgtgccggtgtacttttctttgtaattaccaagttgtctgtaactaacttcttatctgcagcagtaaacttgtagccttgtttttttaggcccaaaagtaaatcttgatatccgcctgctgcgcctacccctttatatgcctttttatcaaaaagctttgcattgttagttttgcccgattcatctgtagcaacatctttgttcttcttcagaagttcattttttgcataagaataaaccttttctgtcgcatcctttttactactattatttgctaccgtaaacgatgccgcactcgcagaaactgaactccctaataataatgtaactgcagtagctactattgcacttcttaaacctcttaccatcaaaatccctccaaataattttaaaaatagaaaccgttttctgtacttaaatataccattatgagtactaaaaataatccataattcgtctaaacagcaaaatattgtcacgtattctcaaaataatacgtaacactaacaatattttgtgaaatgacaattaattacttcgataaaaattctttattcaaacttcttaactttcaatgtttgtaatattggaacatcaataccatatattgacatttaaatatgacacccactataattagtgtcttgatgttattggagggatagaattgaaaattacagtattttgtggtgcacgttttgggaaccaaaaaaattatggtgaaacagctcgattaatcggcaatgaacttgccaaaagaaagattgaactagtctatggtggttctacatctggaacgatgggagctattagtcaagccgtacttgaaaatggaggaaaagtgaccggtatttatcctgaggggctatttgaagatgaacttcctcgaaaaaataccacgtcctttattcaaacgactactatggctcagcgtaaggagctattaattaacagtggcgatgcctttttaatccttcctggaggattaggaactttagaggaactaagccagctattatcgaatatggcgctcggtatcatccctcaaagaaaaattggcattctaaatattaatggtttttatgataacttgattcaactattaaataattttattgatgctaaattcatggatgcattacgtaaggatgatttactaattagtgctgattaccaagtcttgctggaagaattgacagcctcagaaagtaaatcgactaaacaagaacttagtgcataatctaaatttaaataccaaaaaaaggattgccatgatagccaccctaaaagttagaatttagtctaactcttagcggtcactatcactatagcaatccttttttattatttattattttcttcttccgcttttaatgccgcatcgtaaactggaagctttttaaagtagccttctttattaacttggcgtccgcgggcaatacccatttcaaacttattaacgtcgttcgtaatggttgagccagcagctacataactgtgatcagcgatggtaactggagcaacaatgttagaattacttccaataaaggcgtaatctccaactgttgagtgatgtttattcataccatcgtaattaacaaataccactccgcaaccaatgttaatatccgtaccaagatctgcatctccaacgtaactcaaatgccccattttagtccgtgcacctaacttagcgttcttaacttcacaatagttaccaacatgggcaaattcaccgatctcagcttgagggcgtaaatgactgtgtggaccaatattactatcatcatgcatgatggcactttcaatttgtgatgaagttaccgttacacgatctccaattgttgaatcaacaatcttcgaatgcgctccaatcactgaactagaaccaatcttagtattaccttgtatttgaacacccggttcaatgatggtatctggaccgatttctactccataatcaatgtaggtattttcggggtcaatgattgtaacaccattaaccatatgttcttcgttaattcggcgttgcataaccttagtagctttagaaagcgctaaacgatcgttaactcccattgattctgagaaatcagccatttcataagcagcaacaatttcgccagcatctttcatgataccgattacgtctggaagatagtattcaccttgggcattatcgtttttcacttgatgaagtgccgcaaaaagcttttggttatcgaaacaatatacaccggtattaatttccttaatttctgcttcttcagtggtagcatctttctgttctacaattttagaaacaacgccaacctcattacggacaattcgtccatatgagaatggattttcagtacgcgcggttaaaattgtagcagccgctcctttttgacggtgatattcaaaaagattttcaaaagttttagctgtaaataaaggtgtatcaccactaacgatcatggtcattccatctttatcacctaaaattttttcagcttgtaaaacggcatgtcccgtacccaattgttgttcttgaattgcatattctgtacgatcacctaaaagttcacgaaccttttctgccccatgcccaacaatggtaacaatatgatccatattcgttttttcaacttgagttagcatatgatccaccatggcttttccacaaacttgatgcaaaactttatatagttttgatttcattcgagtaccttgacctgcagctaaaatgattgtatttttttccattattactagcgctcctcaatatccttaaagtttctttcaaaataatttccggccttaatttggacctgtccatcttgagatgtatcgacatttaacaaggaagtaaagtcttcaatcgcacgttgtcccttgtatgtaccttctgcgaagacggcaatgccggttaattcagcttcaaattctttcagtaaatcaaccatggcatgaaccgtgccgccacccttcatgtaatcatccacgattaaaactttcattcctcgttgtaagctacgtttagataattccattttttggatacgttctgatgaacgtgaaacgtagttaactgaaatagtcgaaccttcggtaatcacggattcatgacgcacaataataaatggaacatttaaatagttcgcaactgcttgagctaacggaattcctttagtttccaccgtcatgactgcatcaacatcagaacgcatatattcgctagctaacattcggccaatggcccgtaaggtactgggatggcctaacaaatcagacatgtaaagatacccaccgggtagtttacgacttggatccgctagttgttcagttaactcgtcaacaactttgtgagcctcctctgatccaattcccggaagatatttaataccaccagcagccccattagtaatttcaatggttcctagttgttgtttttctaaagttgatttcataatggataaatcttcgctaatagaagatttagcggatgaatatcttgtaacaaaaaatccagaagttatgagcgttcttggatgattgattaaatagttcgtcatatcaatcaatcgttcacttcgcttcaatttcattggtttcactccactcttcttttgcgtattattcgcaaaaaattacttactttttacttaccaatgaatataatatcatagttcattaataatgttcggatttagaccaaaaatataataaaaagactgaatcgtttaggattcagtctttttaattaattatctttttttataatcatcgaaccaaaatagattacacattcaattagcgcaataaagaagctgactggccaattagttacatagcctaaatataaacctaaccagactccaattaaagcggcgctaatcgcaaagagcatcattccacttaccgttttggcaacaatcttagccgcagctgccggcaaggttagcagtacaaaaattagcaatgagcccacaatttgggctgctgtactaacactgagcgctaataccactaaaaataaaattgaaacaaaattggtatgaattcccttgactgaagctccgatatgatcgaaggagtcatattttaagggccggtataaaaataaaataaatactaatgaaatgattgttaacaacagtacctgattaacttcatctcgcccaattccaattacactaccaaacaaaatatttgtagcatagctaacatttttattggaaatcgataagaataaaattcctaatcctaaaaataaacttgaaactgccgaaattgcagattctcgtttggaagcttgtacactcattttaccgattaaaatcgaactaacgattgtaaataatagcattccggataaggcttgccatcccataaaaataccaaaagcagctccagaaaaaccaatctcagataacatgtgtgataaaaatgacatgttacgtcctacaacatacacacccataattccacaaataatggcaatgaaggtccctgcaatgtaggcattttgcataaactcaaaactaaacatctagcaagtcctcctcatttttaatatcagctacttctcccaatgcgtagtgatcttcttttagcatcaaataacgattggagtagcgttgcattaaatcaaaatcatgcgtaacggaaatcacggttaaatcatgttgttgattaaagtgttggactaagttaaatagttcatatttacgaaccgtatctaaactagctgtggattcatctaaaatcaataaatctgggttatccactaaggcttgtgccaaataggctttctgtttttgtccacctgaagctcgcccaattctagtattttgaatatcaactaaatcagtttcttcaagaatttcatcgagttgcgttcgttccattttggatagccacggcatttttccgttttgtaaatttaaggctacgaaatctcgaatagataaaggataatctcgttcaatatttctaaattgaggcacatagccaaccgtcgtccctttgcgaaatttgatgctaccactcgtaggcttaacttgattcagtagtgcgcgaatcaaagtcgtctttccgaccccattttcgccgataatgcttagaaagtcacgacgatctacatcaaaactcaaattattaaataatttttgccctggaaaatccattgctaatttttgaacctgaacaagcgtttcagtcattaatttttaccctcttgtattttactaatttggtttaactgtgaaagcatccacgtttgataattttttcccttcggcatcgtctctgtgacgttcacgattggagtatcgtttttcttagctagctttagaagctcatcgattactttattaccagtttgttgattatttacaataaattcaatccgtttttgtttcacatctttttgtaatttttccaccattttaggcgatggatctgtttcattttcaattgctaaagcgaaagctcggtcgctaactttatatccgagctcatccagcgtgtaatcatatactggctctgtaactgctacttttttgccagcactttttgctctaatttgatcaatcttttgttggattggttgaagtgattcaacatatttcttagcattttcggtaaattctttttgatgttttggatcctttttccctaattccttagctaaatggttagctaaggttttcattgttgataatttataccacaaatgtgggttatcaccatcaactttacccgtgagtttccccatatttaaaaccttaagctgctttttttgaggagtaattttttgaacccaagtatctgttcctactccattttcaactacaatatccgcgtcggtcattaatttagccgtcttagttgtcggctcaaaatcatggggatcgactgctggattatcaataatgttggtaacctgcactcgatttccgccaacctttttagccacttctccataaaagttaagtgtactaatcacttctactttgccactggacttacttttaggtccagcacatcccgcaacaaaaatagtgctaaacaataacattgacactaaccaaattattttttttcgcatttctttctcctaaagagtaataattactatttacaataatcaattataacaaaaaaattttaatatgggacgtctaattttaagataacgttttcaaaaatggtataatgatagtattaatcacgttttgggggaactagtaatgagtaattttattctcgatcaacaataccaagaagaaatttatcaactatatctatatgcatttaatgcgcaagatagcgctaaccgtcgcgatttctggaatcgtcgtttccaacacgctattccctatggaatctccgttgacggtcaaattgaaactagtattttaagtattccttttgaaacaaatttttttggaaccaattttgaaatgaacggtattagcgatgtgatgagcgctcccgaagcatctggtaaagggggcgcgagccaattgatgaaagctgctttacaggatatgtatgacaaccaggtaactttgtcctacctcgcaccatttgctttcagttactatcgacgctttggctatgaacaagtttttgaccatgttacctacactatggctagcgataaattaccacgtatttcaaaaaataccgaaaacgtccaagttaaacgccttgactttagttcaaatactgatttactaaaatcaatctatcaacagtctccactagctcaacggggaggtttaaaccgagccgattggtggtgggattatctacctaaaaaatttgctaatcgccaactggccgtagcttttgaacatcaacaacctactggttatgtcatctacgaacgtaccgctagcgaatttatcatttacgaagttgctaacaccgatattgaaagtcgccaagcactttggaaattcgtcaccaagcatggaactactgccgaaaactttatctatcaaagccctgtcgctgatatcgattttgatctagtcgacgaaccttatagcgtgacaactaccgtccagccttatatgatggcccgaattgttaatttgcaagacttcttagaaaagtatcctacatcaactccaactaagttcacccttgatgttattgatgatgtcctttctgaaaataatggacattggacttttgaatttgacggaaaagtacgttcggttcaaaaatcaaacgtaccattagatactcataccgcgattacaatccaacaattaactaaaattctttttggatatcgctcagcagcatccttggtagaacatggaaaaatcgccggttggacatcagataacgtaaaaaacttagatgccatcaccgtacctcagaaacctattttggcagattatttctaattattgctaaaactattacttcaaaaaaacaaacatctatatttaacgatgtttgttttttactatctcagtgccatttagtgttaccataatttgtaaatagttttaaaggaaggattaacgatggactacaacatgccttttttcgaagaaatcatgcaagatcctcaaaatgcaatttatactgctaaaggatggcatccaatttatagtattaatccccaagcaaaaattttaattgtgggacaagcccccggaaaaaaagtccaagatacagaaattatgtggaacgaccaaagtggtgatcgtttacgcgcttggatggggatttcacgggatactttttataattctggtgatattgcggtaattccaatggatttctattatcctggtaaagctaaaagtggcgacgttccgcctcgtaaagaagttgctgaaaaatggcatcaaaaaatgctggatattatgcctaacatccagcttactctgttaatcggatcctatgcgcaaaaacattatttaaatgttcctcgctctaccactacaactaatctggtgcaaaattatcgtaactttcttcccgaatactttcctttggtgcatccttcacctcgtaacaacatttggctggctaaaaatccttggttcgagcaggaagttgtgcctgaattacaaaaaatcgttcaaaatatccttaaaaaataaaaaacttttgaaaaaggggaactgtttcgaaagtttttttattttaatgaaattgcattccaccatctacaataattgtttgtccagttacataatttgaatctggtcctgctaagaatgatactgcagctgccacatcttctggttctgataaacgttttaaggtaatgtctttagcaaactgttgcataccccattcgtcatctttaccagcattttgtccaacttcatgtgcgatatccatcatcatcggagttcgaacaattcccggtgcataagcattaactgtaataccaaaatccgccaaatcacgtgctgctacttgagtaattcctcggacagcaaacttagtccctgagtaaagggccaaattagggtttccaacaactccggcttgagaagtcgcattgatgatttttccaccatgtcctaatttcttaaatgcttccattgctgcttgaattccccaaagtactccacctacattaacgtgataaactttatcaaattgttctggtgtaattgtatcaattggtgtggtaggtcctaggccggcattattgaccaacacatcaagtccacctagttcctgaatcgtagtcctaacggcttcaaacacattatcacgttctgctacattaaccacgattggaagagcccttccaccattgctattaattttttcagcaactttgttagcagtttcagtattcatatctgccactgccaccgcaaatccatcgttagccaatcgggtcgcaattgctgccccaattccttgtcctgctcccgttactaatgcaactttggttttgtttgccatcatccttcgcctctttgaactattttattatttattttgcatccgcttgggccaccgccgtcattgctaacgcattaatataatttaacggttggtcgtagttaggttggaagaacatatcaaccatggataagtcatcaatcgtcatcttattttgaatagctaatgaaattacattagctgattgagcacagtcatattcgctatagaatgatccacctagaaccactcgtgtttctgggtcccaaactaaccgcattaggattggggtcgttgaaagcataaattcgggacgatagtcttgttctaaggttacagagtctacttctacaccccgtgctttagctgcaccaacagttaatcctgaacttgccatcgtcttaccaaagagtgctactgccgagcttgcttgtgtaccaagatatttcatcgttggtttttcaatgttatgtccaatcaaaattccttgacgaactgcattagttgctaatggaatgtaatcatcttttccagttggattgtaatgaacaacggatgaatctcctgctgcaaaaatatcagggttcgaagtttgcatgtattcattagtaataattgctccgttcttcaacatatccactttgcccttcaataattctgtatgtgggcggaaaccaacgcaaagtacagcatagtcggccgtgtaactgcctttatcggtttttacagtaatctgatcatcaccactaaatccttgaaccatttcgttcatggccaatttaactccgtgatcagtgtaatctttagctactcgatcagagatttcaggatcaaaattcttagctaaaacacttggtaatccatcaatcaaggttacttcgcggccagtcaaggcatattgttcagcaagttccgctccaatataacctgcaccaattacaattactgagttaatgtcatcatcaattcgttttaattccgcagcatgagcccaatttttgcaaagtttaactcgtttattatcgattccatcaatcggaggaataataggtgctgaaccagtagttaccaccaatttatcgtaagtatctgttttaatttcaccggtttttaaatcttttacttctaaagttttattatcggggtcgatactaagtacatcatgttccatattcatagtagcccccaacttagttagggcctccggtgatgaatagaacattttattaggatctgaaacgtggttacctacccaaagggcgattccacaagataaaaatgacaaattattattacgttcgtataccgttacttcataatcggggtgctcagttaaaatttgttgcgccgagaaggtacctgcatgtgtacaacctacaattgctattttcataattaactaacctcctatttgtctatatctaattattaagcgctttcattgctttgtcaacttaactctggtcctttagaacaaaaaaatgaaacaataatcgtcaagtaccgattatcgtttcattagtttaaatttcatgactgatttcaggatgataaactaatttactagttttttcaccaagttgctctagcaggtagacaactgggatttgcgatgtaaaattcaacgatcctactttattttcgggaatatcataagttaaactatagtccgcaatctgcgccaacgttgaagcactattagcagtaattgctacaatttttgccccattttggcgataataattggcctgcgttaaaacaccttcagtttcgccagagactgatagtaaaataatcaatgttttagaatagtcgcgttccgagatgggttgaggttggaaaggatcggtaatggccaatgtgagcatcccataattcgataaaattcgtgctccatattgtgccatactaccacttgatcccattccaaagaacaaacgggtgttggattgtgcaaccacgcgagcaacttcttccattttttcggtatattctgttgtagcagtctgttttagaaattgacctattggacctaagtcttggctcaattcactagccggagtttgatcatttcgatggcgtaaaacatacttaaaatcagaaaaaccctcaaatcccattttcttcaaaaatcttaaaatggtcgtagaagatacgtgactctgcgtggataaatctcgaatagtcatggttttacactcttctagatgactagttacgtatttatacacaaacaattccaattgattcaacgtttgaactttttcataactaaacatcaacatcacctctttaaaacttgattattcttaaacaacttactataaatcttcaccattagatgcaattacttgcttgtaccaatcaaatgagtccttcttcgaacgttctagactaccattaccttggtcatcttgatcaacatagataaatccataacgtttagccatttctccagtacttgctgaaattaaatcgatgcatccccatggagtataaccaattaagttgaccccatctaaggcaactgctttttccatctctaaaatatgatcgtggaaatacttgatgcgataatcatcatggacagcaccatcggcttctttttggtcgtatgctccaaaaccattttccacaataaattgaggtttgtgccaacgatcttgcatccaattcatcgaataacgtagaccaacaggatcaatctgccagccccaatctgatttttgaacataaggattgttgactaaatcacgtgcttctttataggcatagtcggtattttcatccgtagatttagttgtaaatgacatatagtaactaaatccaatataatcaactgcaccctttttcaaaatttctcggtcatcatcactaatttcgacatggatgttttggcgttcccaatatttaggaagccaattaggatattcaccattagcttgaacgtctccaaagtagtaacgcgtttgcatagcacgttcagccatcatgatgtcttctggcttagcagttagtggataaattggacacattgcaatcattgcaccaatttgatattccgaatcaatttgatggcctagttcaactactttagcacttgcaaccatttcgttatgagcggcttgatacatcatttcttccattcctggtgttccagctttaaccttaatggctgaatcttgaagtaaatgatgaggattactccaatcagtttgattattaatctcgttgaaggtcatccagtacttaacttttcccttatagcgtttcatcactgtttcggcaaaacgtacgaaaaagtcaatcaatttacgattagtccaaccaccatattcttttactaaatgatatggcatttcgaagtgtgacaaagtaatgatgggttgaatattgtattttaacagttcatcaaacatatcatcatagaactttaaaccagcttcgttaggttcggtttcatctccattaggaaaaattctagtccatgcaatcgaggtacggaagcatttgaaacccatttcgttaaaaagtttaatatcttcaggataacgatgataaaaatcaatcccccagtgatttgggtaaacttctccagctttaataccgtccgttacttttcgagcagtatctttgtttccagcggtcatcacgtctgcaatgctaactcccttaccgccttcttgccatccgccttcaaattgatgagcggctactgcaccgccccacaagaaattttccggcatcttataatgcttttcagtcatgattaaaacctcactttatttttcggccatttttttatataaatcaacaatttctccagctagatctctaaaagtaatggcattcatgatgtggtcttgtgaatgaaccgttagtagtgaaactttagcatggtttcccttagcttcttcagttaacatcccggtttggacgttatgagcttcagtcaaaaaaccatcagattcttttaatttttcatctgctttttcaaagtctcctgctttagcagcgttgatagcttcaaatgcagagctctttgcgttcccaccattaataattagtcccatgatcacttctagattttgttcttgttcgcccattgttatgctccttaaatttatttatataaaaaagcgcctcaaaaaacgaaagcgcttttaattcaaagcccaattaaacctatacacccattgatgttagagcttccttcaatactttttcaccattcatcatgccgtaatcttgcatgttaattacttctactggaatatctaatttttctttgaaattaccttcaaggtaacgaacttgaggtccaagcattaaaatatcaggattcttttcagccaatttattatctgcatctgatgcggctgttgcgaagatttctgcatctacaccttcagcttcagcagctttttgcattttcgaaactaataaacttgttgacatacctgcagcacatactaacataattgttttttcagccataacgagtcactcctgtaattttatttaatttggcggttgactatgaaaccgcttacgatacaattgaattataaaacgtaggtacaaattttacaagtaccaataattcaaattcgttaaaaagttatcaattagcgttactgataaggaaagaaggcgttcatcgttgtatacgaatatcgcaaatgatctcattgacaaaattaaacatcacctatttgaagaaaaattaccaactgaatacgaattgatgcaagaatatgatgttagtcgtaataccatccgcaaagcagtcgatattcttagtcaaaagggactcgttcgccgtgttcaaggtagtggctactatatcaacgattttggaccacgagctgatcaaaccattaacctaaccatgggagtttcagaaggttttaatcatctcaaactaacctcacgcgttatcactttcgatcgggtggtagctgatgaggctcttgcagctgaatttgggtgcttagtcggcgatgatttgtatcgagtaattcgttatcgttttcgtaatcgtcaagcatatacccttgaatatgcttattacgaacgcgaagaggtcccctttttaccaatcgaagctgcgcatgattccttattagaattcattagaaatgagtatggtgtatccgtcgatactagcgaccaatacgttggaattgaatctttcacttcggaagctgctttcattactgggctccctcaaggcgataaatatattgttttatatcaatcacattatcgtaaaaataatgtgttgtttaatttctctaaaacttattatttagaccgcaaaattcgattttatttccacgcttctaatcaaagctaaaccaacggattattttaaattaaatttttagttgacaaacgaaaagtattttagatatactcatggaagattaattcgaaagttggtaatacaaatgagtcttttacattcaacacatgtaaataatggttggcaaagccggtaattaggttgtaattttgtctaggcaagatacgacctgaatgacagatcgtatctgtgccggctcatttgtgatgaacaaacgataacaacaagcccgcatggattttatacacatccatgtgggctttttttaggcaaaccccatgggcttgcctttttttattataaatttagaggagtggaacttgttatgaagagaatgcttagctttatcgccattatttttatttttttaggatatgcatttgttgctgaacaaaagcatacctcgaaccatcgaaatgagactaaacgcattggtttattacaatatatggatcagccagcgttaaaacaaattcaaaagggagtttatgctggtctaaaagagtccggttatacagtcggaaaaaatctcaaagttgattatcaaaatgctcaaggtaatcaaagcaacttgaagacgatgagtgaaaaattcgaaaatgaaggagttgatttatcaatcgggattaccactcccgcctcaatttccttggctaatacaacttcgactacccccattttaatgagtggagttaccgatccacgaagtgcttccttggtacaaaatttaaagcaccctgaaaaaaacatcacgggagtttccgatcaagcaccactagaagaacaattagaattaatccaaaaattaatgccaaatttaaaaacattaggaattatctacacatctagcgataattctgcaattactcaatttaaaaaattcaaacagctggtatctaagactggaattaaacttaaggcttattcaatttcaaactcgaatgacttaaaccaagtttcgcaaaatatggttcaaaatgttgatgctgtcttcgttcctactgataatacgatcgccggtgctatgtcaaccctcgttaagaatgctaatgctgccaacgtccccatctttccaaccgttgattctatggttaaagatggtggaattgccacctacagtgttaatcaatatcaactcggagtccttactggtaaaatggctgctcgcgtcttaaacggcgaaaaaattagtcagacacccattgaatttatcaagcatggtgatttaactattaaccttaaacaagctcaaaaactaggtatcaagattcctaaagatttaatgcaagaagcacaaaagaaaggggagttaatcaaatgaacttaatcacatcttctattggacaagggctactctggggccttctaggggtaggactatttctcacctttagaattttagattttcctgatatgacggttgaaggaacttttccacttggcgcagccgttagcgttactgccatcactaacggactcaatccactgatcgcgacattacttgcttttctagctggtatgcttgctgggctaattactggcctcctttacaccaaaggccgtattccaatcctattagccggcattttagttatgacggcttgctactccattaatttgcggattatgggaacttctaacgtttcactcctaggaaaacaaaccttattcagtggacaattctttgcgtcactacctaaattttttgatagcgtagtcctcggactgatcatcattaccattgttgtagctatactggccctctttttacaaactaatcttgggcaagcttttattgccacaggtgataatgaaaaaatggcgaaatccttagggatcaataccgatcaaatgaaaaatatgggacttatggtttcaaacggtatgattgcagtatctggtgcactcatcgctcaaagtgatggatacgcagatgttaatatggggattggaattatcgtaattggcttggcttccattattattggagaagtagtttttggcgaattaaccatgaatcaacgtttagtagccgtagtatgtggaagtattatttatcgtttcgtcctcctactggtactcaaggctggattcaatactaacgatttaaaccttatctcatcgttggtcttagcgctctgcttaatgctaccaacgttacggaaaaaatttcattttgaccgaattttaaaacatggggtagccatgccaactaaggagcgtgattaaaatggaacgacctgttattttagaacttaaaaatgcctcagtctatgttaatcgccacacgactgaagaaattcaaattttgaaaaacattaatctaaaagtctataagaacgacttcatcacccttttgggttccaacggtgccggaaagtctactttattcaatgtcattgccggtaatcaacccatcgatgaaggacagattttggtaaatggtcacgatgtttctaatatgtctgaagaaaaaagaactaaatttattagtcgcgtttttcaagatccaaaacttggcacggccccgcgcatgacggtagccgaaaatcttttacttgctactaaacgaggcagccgccgaaaccttaaattacgccgtttaaagcagcatctcgctgagtttaagcagattactgcaacgatgcccaaccgtttaagcgaacgccttaaaacacctactggcaacctatctggtggtcaacgacaggccttaagtttcttgatggctaccattaagaaaccagctattttactattagatgaacatactgctgccctagatcccaagactagtgccgagttaatggaagcaacgcaaactcgagttactgaagacgaattaactgccctcatgattactcatcaactttctgatgctgtaacctatggcaatcgattactagtaatgaaagacggacgaattactcaagacttagatgccgttacaaaagctaatactaatatcgatgaattaatgatttattaatattaactaagcaaacaaactcctgtggaatttgtttgcttttttgttcatattgtatatgctttacaggagttattttcaaccctataaaaacgtttaacttgcgattataccaacgattgtaaacggatacattacgtgttaatattagttcgtaagtaagaaaatacataagaagaaggcgtttaaaatgaaagaaaattttgatttccttatgcctagtgtcaacttctttggctctggagttattgcaaagattggtgaccgcgctaagatggtcaatatgtctaaagtattgatcgttactgataaatttttggaaaaaatggaaaatggacccgttgaacaaacccttcgttcacttgatcaagcgggtgtcgattacgttatttacaacggagtagagcctaatcctaaagttagaaatatccaagaagcaaaacaagtttatttggataatgactgtgatggaattatcactattggtggtggttcagctcatgatgctggaaaaggtactggtattattttgacgaatggcgacgatatcaccaaacttgctggaatcgaaacgctcgaaaatgcacttccaccattgatcgcggttaatactactgcaggaactgcttcagaattaactcgtcactgcgttattaccaacgaagaaacgcatcttaagttcgtagtggtttcgtggcgtaatgttcccctcgtatcatttaatgatccaaaattgatgctcggggttccacctgctctaactgctgcaactgggatggacacatttgtccaagccattgaaccttacgtttctactaaccgcaacgatattactgatggtcaatgtctccaagctatcaagttagtggaagaaagccttcgtgaagctgtatctaacggtgaaaacctagaagctagaactaagatggtagaagctgaaatgttgggagggatggctttcaataatgccgatcttggttacgtacatgctatggcccatcaattaggtggacaatacgacgctcctcatggcgtttgctgtgctatcctattaccaattgtagaacgcttcaacttagttgcttgccctgatcgtttcgcagacttagctgtcgccatgggtgaaaatatcgacggcctttccattagagctgccgctgataaagctattgatgccatgcaacaacttaacgacgatgttggtattccaagaagtatcaaagatttgggtgctgatcctaaagatttcgaactaatggctgaaaatgctttgaaggatggtaatgccttctccaacccacgcaaagctactaagcaacaaattgtggaacttttccaacaagcttacgatgcaaaataattactcaacaaaaaaagatgaactgagatttctgattcagaattctcgttcatcttttttatttatttggcaacttttttattacttttaacactaaaggaaagaattaatcctacgataattaatgcaatcgtaaagtagaaaccatagtgtgtaccattagtgaaggcagcattcaaatgacctttaccaaaatgattctgataagctacttgtccgattcctaataaacttgttgctaaagcagttgcaatcgcaccaacgatttgttgcatggtattcatgatcgtactaccgtcaccagattggggaccttcaagcgaatttaaagcatatgtttgagctggtgacattgccaaaggacaaccaatcatcaaaataacatgagcaataattaaataagcaattgaagtatttaccgtagtacataccaacataattgcaccaattaatgcaatcactagtccaatacgaattggtgctttggcaccgatcttgtcgtataaacgtcctgcaaccgctgaaacagcggcattaattacaccaccaggaagcatgataattccagttagtgcaactggtaataataaacctttttgaatgtacattggtaataagtacattgctgataaaataataccaaaatcaagcataactaagattgcaccagttctaaatgcaggaatggcaaaaatctttaagtttaggacaggttcagcaagcgaaagttgacgtttgacataaaatgccaaaacgataattccaagtgctaagatacctaatacaattggcgaaccccagcctttttcactagcaaaactgacaccagttactatactagcaaagccgataattgattcaatcaatgaaattacatcaactttaggtttagtaagttcaccaacattttttaatccaaaaatagctagtaacaaagcaattgctaagaaaggaacgaacatccaaaaaatccagttccatgataacttagctaaaataatacctgtcaatgtcggtccaatggctggagcaaacataattaccaaagcacacatgcccattgcagcacctaatttataaggtggaaatactaacatggctacggtaaacatcataggtaaaattaaaccagtagcgattccttgaatcattcgaccaaccagtaataatgcaaaggttgatgatagagctgaaataacagaacctacaataaacgctaataaaccaaaaataataatctgtctagttgtaaaccattttgatattaaactagaaaagggcaataccacaccaatcacaagcatgtatcccgtaactaaccattggatagtacccgtcgtcacatgtaaattatccattaattgtggtaaagcgatgtttaaagatgtctcactaaacattcccacgaaggccccaatcaacatgctcgccattaccaacattggatgttcaactggtactcgcgcttgcatcatgccgttgcttttttcttcattattcattaaaaaatacctctttcttcaaaaacatagcttgttcactatagcaaaaagaaaaaattttcgtaagtatttttttgagaaaaataaaaagaggccgttctgtaaacggtctctttctgataagaatgcctgttgaaagttatctaacaactaagacagaaattggggcatgtttagccatatacgaagcttgagaaccaaaatatttggccatccctgttttagaagatgaaccaattactaacaagtccggatcaacactaggaatcacattttttacaatagtttccccggcttcgccttctgctatgtatgtttgtacttttttaatgccaaattccaaggcaatttttcgatagttttggagatgtttttccaattcagttcgcttttgcgtaatgaaatttttatctaaagcttggtaaatattaatgtcattttcttcaattaccgtaaccaaatctaactcagaatcatcctgtttagcacgattcattgcaaaacggaatgccaactgcgcatcaggggagtcgtctacccccaccaaaatcttactaaatcttttcggattaaattctcttgaactcatgattttccctccatgctaatccctattatccttttgaatatggtagattatcaagctcggttcgaactaataaaacatccatcaatgcaactcttgtaacatagtccgctaccgaaccaatcattgctcgttggaaagcgttcaaccccgttgcccccatcataatcaaatctgttcccagcttttcaggcatctctgtagcgataatggccttaggatcgccagcttccacatatacctcaacatcttcaaaatcatatttacgtttgatttggtccttcaaatcttcaacatactctttagctctacgaagggatacttcaacataatccatgttactgcccatatgtccgtacacatctaaaaaccgtgaagattgaattacagttaaaatatctaagtgagcatggttacgcttcgccacaaaaatcgcttttttcaaagctaattcgcccttaggagagccttcaactggcactaaaatcttcttatattcaagcatatccattactcctctatacgtttctgttatcattataataaattttttaagatagcgctaccaataataccttagaaaaaagcgagtccccgctcttttcatttaaaattatcttaagaagcgatgagccaccattaccatttcttggttagtctgcacaagtccatcttttatccattgtacaaccatttggtttagtcctccagccacaaaattaacccacattactgggatatccgtccgaagtttaaagattccttgttcaattaaatctgttaaataaaagtttagtttatcatacaagcgatcatttaaatcagcatgaattagggcttcaatatacgaagcattccgccgacagattgagaaaaacgcttctaaaaaggtcccaatatcatgattaggacgtaccatcagatagttaaagaagtcagtaaaaatttgatctattttataatcaataatctgatctttagttttaaagcttcggtaatacgacattctagataccgacgccgtttgacaaatattacttaccgatatactggctaagtcattatcttttaacaactcaaatagtgcatcgatgatcttctgttttgttgcttcatgattagccattattatacctcacaaaattcgaactaaatatacttcatgacaaaagcccttcaagctatttacgatatgcttggctcggcttgattttgacgcaaccccaaataccgttggcccagtcccactcatttgagctgcatctgccccgtattgtttaattcgatttttaatttttaaaacttccggatgttcttttccggttacttgctctaaaacattgcccatataacgacaaatgtctgtataatcttcacgctcaattgcatctaaaattgattcgatattagaatgttggagctctttgtgttcgattttactaaggatatacggcgtcgacacactaagtttcggtttggcaatcaccacccacataggaggtaatttttttaaaggaattactttttcaccttttcccaaaacatgtgccgtccggctatacacacaaaatggtacatcggaatcaatttctaaaccaattttagctaatactcctaagctaagctcaagattccatagtttatttaatcctcgtaaaacggcagcagcatcagacgaacctccgcctaatccagctgcaaccggaatgtgtttacgtatttctataattactttggcacgtacgtgatatttttcttgtaaaatccgggcagcttgatacgccaaattacgactatcgttaggtaaaaaaccggtattcgttcgaactttaattcccattttaccaggaatactttcgatttttacataatccgctaaatcgaccgaggtcataatcatgttccattctggtaatccatcaggatgattaaacggcgtatccaaaaataggtttaacttggctggagctttctcggtgatttccatctacttcacctgtttcgtttgcttttaacctaaattatactaaaaaatggtaaaaataaaaaaggctaatagtcataaaagcttaaatgccccaactatcgccaatttaattagatattagtcttcatcaaattcttcaacgtcatcatcatcaagctcaattgacagctcagcttggtcgatttcatcatcaaagttaacttcgatgtttcttgtcaaaatatccgtgtaactgtatgacacacgttcgaaggagttctcgtcttgatccaaatctactacgaaaacggctggatatgtcatatgcaggcggccacgacgcttagtaatctttttacgtccgatttgagcaaccaccagtaattcttccccgatgcgaccatcgagcttatccttaattgtagctagtgtgtttggcattaacttcaccttcccatgtgaaacattctatcatagtttcacaaagtttgcaattttaccacacgtacaatttaatatcaacgctttacatttcatttttttatgcttcaagcccatgaaaacggattattttcgtttaaggccttcaacttgaatccgattatgcaatttaatgaaatctaacacggttaatcgctctggtcgcacttgtggatcaatacctaaatcatccaaaacattttggattttagctttgatttccggttctttaccataaagtccctgcatattgttccaaatatttttacgacggtgcataaagcatccgtgaaccgtcttaaagaagtctttatcgtcttctggcattacttcccagtcagcacgaggcgtaagactcacgatggctgaatcgaccttaggacgcggcacaaataccttagaagaaacatcaaattcaatttgcgtattcattcgatattgaaccactactgataaggaaccatattctttgtcgccaggttgggctgtaaggcgttctgcgacctctttttgcatcataacgaccattttatcgatgggcaggatactagccataaatgtctttaaaatgggggttgtaatgtaatatggtaagttagctaccaatttcaaacgacgttttccgtctaaatgattttcgacttcttcgtttacatttgcttttaaaacgtcttgattaaccaccgtgatattatcgtaagggctaagggtttcatctagaacgttcattaaattacgatcaatttcaaacgctaagacatgatgagcacgtttggcaatttgttcagttaaactaccaattccgggtccaacttcaattacgtcatcctcaggagatacttccgcagcatccacaatatttaaaagtacgttagggtcagtcagaaagttttgtcctagacttttcttagctgataatccatatttttccaagatagctcgagttcgagttggattaccaatatccatttgattattcattaattcctccattaatttgttctacagcatgattaaaatctgatttttcaacttggaacagttgtagccttttaggtagttgtttggcatttacgtatccaatccctagtaaatctcccaaacgaattcgccgttgttttgccgctgaacccgcaattaatccagcatcaatcaaatcactctgagtaatttgcagtgcagcatcctcatcttccgtgtaaagatgctcaagtgattggcggattacctccggagtggcatgttcgactcctaagcttcccttatgatccggaacagcatcttttcgtttcaaaaaagcatgcttaacgttaggaacttcggctgaaatagttttacgaatcttttcgccagagaaatctggatctgtaaacacaattactccgcgactctcttgcaattggcgaatttgttcgatggtttcatcagataacgctgatcccctagtttccaaggtatcagcgttgacagctaggttgattcttttagtatcatcttttccttctactacaatgacttctttaattttcttcatttttaatcccatataatttacaagtattatcaaaagttatttcggctaattgatcaggtgccatatcgcgatgccgagctaaggcctccagaacatatagtgaaaaagccggttcattttgttttccacggagtggttctggcgctaggtatggagcgtcagtttcaaccataatacgatctaaaggcacttggcgaactgcctcatggactattttagtttttttgaaacttgccactccactaaatgaaatgttaagcccgatatccaagaacttttccatccattccacatcgccattaaaactatgcataactcccttgattttatccacaccagcattttttaaaatcgcataagtatcttttgtagcatcccgattgtgaattgaaattggtaaattttgctcgatagctatttgaagttgttcttcaaaaacttgacgctgaaccttttgaggcgaagtatcccaatggtaatccaatccaatttcacccaaggctaccactttcggatttcggagctgttctaatagttttattcgttcagcttcgtgaaaatctttagcgtcctctggatgccaccccacaatggcataggtatgaggatatttttcggctaactgaatagctcgttcatttaggatcgtattggaaccaacttgagcagtcgctatgacacctagtttttgggcatgctcaatatacttttgttcgttgccccaaaaagcatcatcatttaaatgcgtgtgtgaatcaaaaatatgcatttttgcctccttgaatataaaaagggctgggacaaaacacctgtttcatcaccagtcccattgtgttaaatctttttaacctaaaacatcgccgttttggtgttggtcgtcgaccatcacgacttttacttggtcgtcatgttcagttgataaaatcattccttgactcatttccccacgcatcttacgcggtttcaagttagcaacaatcacaacttttttacctactaaaacgcttggatcaggatatgattgagcaattcccgaaagaatttggcgtggttcttcatcaccagcatctaacttaaacttcaataacttgtcagcaccctttactggacctgcttcaagaacttcagctactcgaagttctaccttatcaaaagcttcgatccgaatttcttttttctggtctgttgccacagcttcggcctttttctggttagcttcagccattgcagcacgcccttttttcttgtctgattgagtcatttggtttttaaggaactcaacttctttttcaacatccaaacgagggaaaattggagttcccttttccacaacctttgtatcagcaggaatttcaccaaacttcaaaccttgaagttcaagttggttaacatccaagcccaattgtgcaaagattttagttggcgactgagtcatcatcggttggatcaaaattgcaattacacgcaaactttcagccaaatgattcatgacacttgctaatttttgtttagattcgtcgtcatcattccgtgcaagaatccaaggcgtggtttcatcaatgtacttgtttgtacgcgcaactaatttccaaatttcagctaaagcatctgcaaaatgaaggttgttcattaagtcttcatagttcttaattgtcgtagcagctgtggtttccaaatctacatcaacgtcattaacgccactttggaaagttggaataacgccgccttcatacttgttaatcatcgctaccgtacgattcaaaagattacctaaatcattggctaaatcaaagttaatttttgaaataaaatcttccggagtaaagttgccatcatttccgtaaggcatagctttcaataagtagtagcgtaaagcatccaaaccatagtttttaacaatcgtttcagggtaaataacattaccctttgacttagacattttactgtccttcatcaataaccaaccgtgaccataaatttggtcgggttgttcgaggcctaaggcgtgcaacataattggccagtaaattgtatgaaaacggacaatttcttttccaaccatgtgaacattggcaggccagaatttcttaaagttaccatcttcgtcactgctataacccaatgcggtaatatagttagacaacgcatcaatccacacgtaaatgacatgtttagggtcatttttaattggaactccccacttaaaaccagttcgtgtaaccgcaagatcttctagaccaggtttgataaagttattaatcatttcattcattcggcttgccggttgaataaaattaggatgagtttggtagtaatctaataaccaatcggcatatttgctcatcttaaagaagtaagattcttccttaactaattcgacttcgtttccagaaggagcctttccaccagttacgttgccgtcagcatcacggtaaacttcagctaattgagattcagtaaagtattcttcatcagaaactgaataccaaccttcgtattcaccaaggtagatatcgccttgatctaataatttttgaaaaatcttttgaactgctttttcatgataatcatctgtggtacggatgaacttatcattagtaatttcaagtaaatcccaaagttttttgatatcctctgccatgccgtcaacatatgctttaggagtagtgtttaaagcttcagctttttgttcgatttttaaaccgtgttcgtctgttccagttaagaagaaaacgtcctttccttctaaacgttggaagcgagcttcagcatcacaagcaattgttgtataagaattaccgatatgaagttttcccgatgggtaataaatcggcgtagtaatatagtatgtgttattttctgccattatggttcctctattctagtcaagttaattaattgtaattgtatcatattttatagcgtcaaaaacccgtctctttaacgaaaataacgatttattaatcaaaacaaatccatctgaactggacctagaccctcaaagcgaattcctaagattttttgcaactctttcgcattatcgacagcatcatggtttccattgttattgaagataatggttacttcttcaactcgttcagatactgccttaacccactgtgctaactccgttaattcatccgtagaataacgataattagtgcgttctttccgccattctttaccactcgtaaaccatccctgagcattacgtccgtgcaaacgaaacatggcttttttagcactagtcacttgaagtaccaaaggcatcccttggttgccgtcaaacggctcatcgacaattacatttatcattttaaggcgctccaaatatgataaagtgtccgattcgactgcctctgtgaaccaactgggatttctgaactcaacactaatcggaattcgatccatcatttggcgaatttcaaataagtagcggatattagtcaaatcacatcgaaacgaaggtggaaattggaataatacagattccaactgtccattttggattaaaggctgcattacctttttaaaattagtaaattctattcgtcgttctggtgttaaatattcatccccatcaacgccgtcgtggagggtcataacccgagaagctttaaagatgaatttaaaattatctgggacttgatgttgccaattgacgacattggacaacgatggaatcgcataaaaagaactgtccacttccacaatcggaaagtggcctacatattcttctagcgttgatttaggtttaccttcaaccgataaagttggatgatcagcccaagtacttagtccaatctgaatcataaaatccccccattaattaaaaaaactgaaattcaaatcatctgatttgattccagtctaatttatttttatttaaaaaacactaatattgctgaaataataatcatagcaatgttaacacgcattaaaaacaaatcaatgatgcggccttccactcgattagatactaaacggattaaaaaaaccatcaagcctaagtaacataataagatcatgggtggtactagtaacattccaagtaatccaattaaaaatatcaccaatccaattttttcagcctgggatagacgccgatatgcaaaagtattaaccaattggacatgcttttgctttgcaatggtcaaacgatagatatcataaaccttaactaaggcggcaataaccgtatagacgaacaagaaagtccctgctacctttccagaaggttttccactaaaaaattcaaatccaatacctgatgctagcattatcaaagtactaaaaaagaagcccacaaattcttttgtatcagaaacttgattgactaccgattcttcagcaggcgttaatttacgaacatttaatagcatatggattagtgcgtaggaaaccgctcctgccacaattaacgagaaaaataaaattgtccaaaaattaatgctacctgttaataatttaaataagaataacccaattgaaactaatgagagaattccagcaatattagctgttcgattccatcctttttcattcatagtatttaaaatctccatagtataagtacataagtaattttaattctaccatttaatagctctcctatctagattgattcgtcataattccctttaatccacgaactgttatataatgagaacaaatgaaaaggggtgggaattatgagaaacaaattgtataaatctagaaacgataaagttctttcaggtgtaattggtgggttcgctgaagcgtacgattttgatacaacgctcttacgaattatttacactgctgtaaccctctttaccggttttttcccaggattaatcctctacattgtagccatgatggtaatgcctgaaaggtaattcttacttttaactggatgcattgaactggcatctggtttttattttgattgttcatcaggctgaaaatcacaatttcataactaacaaaaaatcctgtaactaaaattactttagtccaggatttttattttatctaatagtataaggcatcttcatttcttcaaagaagtctttaacattctttgcatataattcacggaagtattcgtcacttggcatgtctttaggtgttggtaccacaaaggcgttttgttggtcgctaattcctaatccaacaaatccgcgtgtatcttgagctttttcatgtaaatctgaatggaagatttggaataattgtttaactgataaacgaagttgacgttcactaaatacacttcccaatgtcgcaaattccatcgcatgaatttctggtaaatcccattcttttaattgagtatcaattaattcgaaagctttgactacttttcgacggaaatcaaacggattactgatggtccgttggtcaagttcttgcataatttttttagcagcttggtaggttgttggaaaagcatccatcaaccgcgtttcaaagttcgctaaaccatttccatagaacgtaatggcatccatcatcattattagacgaatagtactaaatccgtcaactttaccagcatcctcagcctctacggcatcctcaatccccttaaagaaagcttcttccacctcatcatcgattaaataatgccgacgttgttctttgacgacaacttcgtgggcgattacatcgtaaagctcagtaatcaaaaacatcaattgattatccgtatctttttcccctgttgataattggaaataaagttgtggaaaacctttcaaaatcattaacatgtgaattaactcatgggaagcagtgtaattaggtgccgtaatatcattgaccttgattaacatcttaccttcttcaacaaattgctgggcttggtcgtgacgcacaaaaccggcctgttcttcaccaaaaccaatccgtacttctcctggaaaacttgcattaacttcttcaagaagcgattttactgtatcatttacttcaactttgctcatcattatccttctttcttagctgtttaataatttgttgggcatttttggcatcaattctttcagcttggactaatcggttaaccgcatctcctagctctgcttgagtcgctccatgttctattaaaagtgatttagcttgtagtcgcatatgtcctgattgaattccctctgacacaatagctcgtaaagcggccagattctgagctaaaccaatcgaagcaattacttccgccaattgtttagcgttcttaatttgcattaattttaagttcagctgagcttgagtattaatcccaatcgaaccaccaacggttgccactggtaatggtaattccattctgccaactagttgatcaccaactacatcccacgtactaagtccttgatattgaccattttgagcagcataagcgtgggctccgctctcaatggctcgccaatcgttaccagacgccattacaaccgcatcaattccattcataatccccttattgtgcgttgctgcccgatatgggtcaatttgtgcataatcactagctaaactaatccttttagccacttctactcccagttggttaactggaatttgacacgtaacttctgtcagagcttggtcagctaaattagataatattgccatatcaacatcgatttgttgtgttactaaatctttcttaacagcctctaccatggaattaatcgtattcgctcccatggcttcgcgcgtatcaaccattaaatcaactgacagtttcgtggcggttaactgacgaatgcgtaaattttttgcgccacctccacgagcttgcatcgaagggtgggctgcattagcgaccttcaataaatgtgatttttgtttttttacataatcgattatgggggctggttgcgcactgctaattaataactggcctaacattatccgtctactattcgccgaaaatcctccggctcgctggaccattttagctccataactagccgccgctattactgacggttcttcggttaccatgggaactacataagcttgaccgttaactactaaattaaccgcgattccttctggtaaattaaaatcagtcagataattttcaatttgttgttgatgaattgagtccgtagctaattcagttagttcagacaaatcaacgtcggtttcctgcgctaattgctcgagttgctgttgacgcgttaatttgtggtagccttctatcattaaaactattcctcttttctaaaattgatgtactccgaaatgattccttcccgaacgccactttcagaaaaaattactcgatcagcgtcaatcatttgtaataacatcaccaatggtaacattccaccaacgataatatctgcacgcgtagtttcaagcccagacatttttttacgagcttctaaatttcgtgtaattaacgatttgaaggttcggttaaccgattcagttttgagccgatagccgtggatattattaattctagaaattttttggtgacgacgattcattcgggccaatgtccgattagctccgcctaagagaacaatgggtttattgaaagcatccataatccaccaaacatctcgtagttgcttattcacaaaaatttcagcggcaaataaattatctgctctaactacgtccgttaagcggaaccgttccgataaagacacagcgccaatcggaatactgatcatatttcgcgcttttccattatggacgtcaattagctcacagctggcaccaccagtatcaagtatcaaacaatccttaacttccaaggaattgattacacctaaataatcgtaataggcctcatcgtcgccagacaagacgtgtaatttaattccagtttcttgcttaacgcgatttaaaaaatcgttctgatttcgcgccattctaacagctgctgtcgtaatccctctaacttctgtattaggatattcttcataaatttctttaaatcgacgtagggctgcaatggtacgattcattgcttggggacgtaaaaggcgctcgcgccccattccttctgaaattcgtgaatcttctttaactcgcttaatttctcgaaaggttccatcatcagcaatcgaattaattgccattcgagcggagtttgatcctaaatctactattaccaaatttttcatcctggtgtcctcatttaaattgaaatattccttttttattttaccattacctaaattagaaaaggagctcatctcgcctatcaactaaaataaaaacaaacgtttacattaatccttaataaaaaaccacacttcttttagaagcatggcttttacgattaaagtcggtgatcaaaatagttaattccaatggcatctcgaacttcctttaaagtctgttctgcgaccgcgttagccttgtcactaccgtcttttagaatttggtatacagcgtcaatatctgcttcatacttttcccgacgctcgcgaattgggcgtaattcgttttggagaacttcatttaagtaacgtttaattttaacgtctcctaatccaccagcttgatactgatctttaagttcttggactttttgcttatcaggatcaaagatgtctaggtaagtaaatacggtattaccttcaatatggccaggatcttctacccgaatatgttgaggatcagtatacattgacataactttcttttggatagtttcttcgtcatctgccaaataaatagcattacccaatgatttagacatctttgcatttccgtctaatccaggaattcgtcccattcctttaggtgggaaatatccttctggttcaactagcacttctttttggtagatattgttgaaagaacgtacaatttcacgcgtctgttctagcatgggttcttggtcatcccctaccggtacagtatctgctttaaaggctgtaatatcggcagcttgactaaccggataagtaaagaaaccagctggaatactttgcccaaatgccttttgtttaatttcagttttaacggttggattccgttccaaacgagctacactaaccaagttcatataatgttgagtcaattcacttagtgctggaatctgtgactgcacaaagatcgtcgatttagctggatcaatgccaactgctaaatagtctaaagcaacttggattagactattacgaattttttcaggatcacgggcattatcagttaaagcctgcatatcagcaatcatgatgaaagtttcataatcacctgtattttgaagttgaacgcggtttttaagtgaaccaacatagtgtccgatatgaagttttcctgtgggacggtcaccagttaaaataatttttttagatgtcataatttcctccagatataaaaaatcctactattcaaaaatgaataataggacgaaaaatcgcggtaccacctaacttgtgactccattataaagccaccgctctagtgaaagataagggatttcgccctgttaaacatcaatccatttcgccttccatgagacttctcaacaactgtctctctctgttagtggttaactactactttcattttaaattagaaacgttagccttgtcaaaataagtttaactttatctcacaagctggtctttcggttgactttcattcttcctccacctagaattattcaagcattaaaatcaaggaggtggctgatttggacgaacaacaacaagaacagcaacgagttacggaagtcattgaaaaaatcgacgaacaaaaacaacatacagaagatttatatcataaagcccatcaagaaactagccaggttgaaagaaattactcacaaaatgcaaaggttaacttgattgaggccgatgaccgcatcgaaacccacgctgaaatccaacagcaaaaagggctggtagctcgagctgtcgagaatgaagcaattttaaaacgccaaattgatgaattaagcgatcttcaaaaatcaccctactttgggcgaattgatattaaagatgctgatgaacctgatattgaatcactttacattggaatttcgtcttttgctgatcgggatggtaatttcctaatttacgattggcgtgctcctatttcaagcatttactacaatggtactctgggaaaagttaaatatgataccccagcgggcatgatggaaaccgaactcattaaaaaacgtcaattcactatcaatcatggtgaaattcaacatatgttcgacactaacgaaacggttggcgacgagcttcttcaacaagctttaggcgaacaaaatgacgaatacatgcgtaatatcgtcgctactatccaaaaggaacaaaacgacataatccgcgatgtttatagtgatcttctagtcgttcagggcgtggctggtagtggtaaaacctctgctatcctacaacgtatcgcctttcttttatatcatagccgaacttcattaaatgctgatgaaattgtacttttttctcctaataagttgtatagccgttatatttcggacgttttacctagtttaggggaacgaaacatgcgtcaactaaccttagccgaatttttcagccgtcgtttggaaggcatgcaggtccaaacgttatttgaccgttttgaaaatcaacaccaactcactgaatacgagcaaaacctcattgactttaaagaaagtcaggattttattgaattaattcaagcttatgaaaaacaactttctgctaaagaaattaaatttaccaatattaattaccgcggcgaaattttcttttctaaagaacaaattcaagctatctttgaaacctttcctcttagtatgagcaataaagaacgtcttttaaaaactaaaaatgcgctaatcaaacttcttcaaaaacgagttaatcaggaaattaaacaggactgggttcaaaatcaaatcgaccaaattagtgacgaaaaatatcatgaattagtggggacgcgtcactttaaatcatatgatgaggaaaatcattttatcggtcgccaaatagttgataaagaattccaaattatcgatgacgctatctttaataattatttcatcgattcctattctcaatacgcggactttttgagtcaaatcgacttgggtgacttcgattggcaaaaagttgctaaagctttcactgatgcaattgaacttcatcagattcatttggaagatgcggcacccatgatgcttctccgtgatttgattactggaagtggtactaatcgtaaattccaatatgtattcgttgatgaaatgcaggactactcagttgcacaattaatgtacctaaagcatgcttttcctcgcgctaaattcaccttactaggtgatagtgagcagaccctgttcaaagatgttaccgaaccacaaattctattagcaaaactaaagcaggcttttcatgttaagcgagctaatttaattaccttaaatcgtagttatcgctcgaccgcccaaatcactaattttgccgcggcacttctacctgatggtcataaaattcaagcttttagtcgtgaaggagatttacctaaaataatcattgctgataatgaacaacaagccgtagtcgatatgaccaatctttgccgggatgaattacagcagtatggtaccatcgctattttaactaagaacatggctgaaagtgagcacgtagcaaccttgcttcacgaattaaaaccgagcttattaaacgatggcgaccgttccttacccaaaggcattgtcgttttacccatttatttagctaaaggactagagtttgattccgtaattgcctataatgtttccgaagctaattttcctggtcgtttgtggcgaggaactttatatacgatagcttccagagccatgcatcaactacacttgattagtattggtaaagtatccaatttaattacccaaattaagcccgatcaatttagttttcaaaaatcatttaacatcactcctcataaatcacaaaaactcgacgactaaccgtcgagttttttgtttacattacttcaattaatcctactccagcaatcataatgattaagcccgcaatcttagcaactgagatgctcgatttcatcgatcctaataagccaaactgatcaatatttaaactactgataatttgtcccagtaaaactagcactactaccgttccagttccaatctgtggtaccaaatatgcatttaaaaagatataagctgctccaaaaaaaccgccaatccaaacccaccaaggtgttttctgttgaacaactagccggatattttttaaagttccttggaatacagctaccaggaataacattattgttccaataaaaaatgatattaaagcagcgtggataggggcctgtaataatccgcctaatcgtccatttaatgctgcttgaattgcgagcattccgcccacaagcacgccgaaaatttgccataaccatttccacttaacccgttgttcagggggtcttttcatagaattccgtgctaaatattctggtaaggcgaccacaattaatacccccacaatcaatagtagaactccgaccattcgcattaacgaaagtggatggcgtgtggtgccaaacatgccatagttatcaattatcatactcatcataatttgacctaaaacgggcatgatcaccgtttgaacactacctaaaatggggaataaaagaatattagttgttaatccaatcatccccaaaacaccaccgagatacatccaccatggaatggcatgtaattgcgcactagttaataagagctgcccaccgcttaaaatgatgattactatcaaaaagatggttcccaccataaaagaaatcaaagacgatacgaatggtgaaataacatacgttcttaatcgtgaattaaccgccgtttgaaagggtactaccgcacccgcaaccaatcctaacatcaatagtcccattatgtgcttcctttcaacgctatcctagtttcggttaaagcgtttccatcattactataactttattttaaactaaaaaaatcatgacacaagcaacaatgtcatgactttttacattttcattttctattccacattgataacaatttttcctctagcatggttagtttgactgcgttcgtgagccgctcgtaacccatcttcagtaagtggaaatgtactatcaataattactttaacctcgcccttagccactaaatcacctagttcagccagttgtttgccatttggttggagccaccaagaagttgctgaaggttgagcgtcctgttgggcttgggttgggcgtcccgcgatggtgaccaatttcccggttggtttcaaaattgctagtcccgcttctaaatcatcaactgtatcaaaaacagcatcatactgtttaaggacttccccaatttggtgttcatggtagtcaatgacttcatctgcccctaaattagttaaaaattctgtatttttggcgctagccgttgtggctacataggctcctaaatgtttagcaatttgaatggcaaagatcccgactccaccagctcctgcttgaattaaaactttatcaccctttttaacctttaaccgatctacaatcacctgccatgcagtcagtccagctaatggaattgcagctgctgcttcaaacgaaacattgctaggctttaatgctaatttatcttccttaactgccgcgtattctgcatatgtccctttcgtcccatcttcataaatatcgggtctagcaaagacttcatctccaactttaaaatgcttaacatctttaccgacttgggtaattactccggaaagatcccatcctaaaacaactgggaattgccaatcgtacatttgcttcaaaagtcccattcgggctttccagtcaatcggattgatactggttgctttaattttgaccaagacctcgtcgtttgcaatttgaggaatatctaactcctcttcatgaagttggtcaacatcaccatatgcgctaatcgtaattgctttcattaaaaatacctcgtaattttcctcttactttaagattgatctagtaggttatatgttaacacttatcaaaagtaagttctatgttcggtttctagcaaactcccagaacaaatttacaactggtaccatgtctccctttcgttttataaaagctaattggctgctttttttaggtatgattggaattactgcaatattaggatagtttgttagatcaaatgatttatccataacaacagaaacacccattccttcattcaacatttccaaaatcaaatcaatcctttggccctcatacattattcgtggttgtacattaggcttttttaaaattggaataattggatttgtaccagaaatcgttccttctaataccaaaaaagattcgtttctaagatcctgaacttggatcttttcaaaccgagacaaggggttatttttaggcactaatgcaacaaaataatcggattcattcacaattacgtcgtatttttcactgaccggactaaatatccttgtaaaaacaatatctgttccatcatgattaagttcatttaacaaggaatccgttccagcttcactaaatttcaaattaatctctggatattgcttggtgaattgcgtaatcgtatcaaatgctgagtattgcgaaattgaggggattcccttaaccactagcgtacctttaggattatttttcaaagcgtcaattttttgcttcaattgttgttctttatctaaaatctcccttacatctggcaatacgtttaaagcctcttgggtcaacgttacttttcgatgttttcttgaaaaaagttttatgccccattctttttctaacgccataatatgcttagaaactgtagcttgcgttaaaaaaatttcttctgctgttttactataattcttagtctgtgctaaattataaaatgtcgctaattttttagtatccattacatatcttccatctattcttatttggaatatcttaccacaatatttgaattgttccttacttttatgaactgtaaaataataccttgtcagctccaaaataagtacttaatcgatataaaggggggattttggtgccaattggtataatagtaaatgttttttcaatttttttaggcggttttttaggtgctctaggtggtcgaaaaatgtctaccgtcttccggaacaatttaaatatgacctttagtatcgcttcaataaccatggggatttatacaattgcccctatgcaaaatctagctgcagtcatatttgcaatcattatcggaactggtataggaactttacttcactttggagattatattaaacatggagcagaatggatgcaaaaatttatttcacgttttgtttcttcaccaatgatgttagaccaagaaacttttgacgcaactttgataacgattattgtcctcttttgtgctagtgggactgggatttatggttcattaactgagggtatgaatggggacgctaccatcttaatttcaaaatcaattcttgatttttttactgcaataatttttgcagcaaatctgggatatgtggtggcgttaattgccgtccctcaatttttgattttaatgctactatttttcttggcccacctaatttatccactgactacccctgctatgttacttgatttcaaagctgctgggggaatccttatgctagccagtggttttagaattgttcaaatcaaaatgtttccaacggccgacatgattccaattatgattgtagttatgcccatatcttggttttggacgactatcatcctaccgctactatgaaaaaacgatgttaatttatgcacgtaaaaatcataaattaacatcgtttttatatattatttcataaacgctttaattcgccttactgcttcactcaataatgtttggctcgtcgcatacgaaagccgaatatgtcccggcattccaaacgcttcaccggcgacaacggctacatgagcttcctttaataaagccatcgccaagtctgtagatgtggcatatcctttaattttcatagcttcagtaacattcggaaataaatagaaagccccttctggcttatgatcaaaactaaaaccggagattgtttgcattaaatcaaaagtttggttcaatcttttttcaaaagccaatcgcatctcttccactggcttttggtctccacgcaaagcttccagagcggcatactgcgctaccgctgtcggatttgatgtcatatgaccttgtaaagccaatatttttcgaataatttgcggagcagctacagcatatccaattcgccatccagtcattgcatacgcttttgaaaccccatcgattaaaatggtattattaacaatttcatcccccatactcataactgaactgaattttgccccattgtaaactaatttaccgtaaatctcatctgcaactaatattacgttgttatcgaccgcccattgtgcaatcgcccgtgtttcttcttctgaatataccaatcccgagggattttgaggcgtatttaaaattaacaatttggtgctggctgttttaaaacgacttaattctgaaggagtagttttcaagtcactagcttgaggatggatggcaatcaccgaacttccggccaatttcacctgttcctcataactaacccagaatggggcaacgatcatgacttcatcgccttcattcaataaagcttggaaagtttcgaacagccccattttagctcctaccgttactgccacttgttccattttggcatcatagcctgtatcggttttaatgtgcgtagtaactgcttggcgaagttctgggagccctccgactggtgtgtaataacttgatttaccagtttccatgctttccatcgccgctttaataatcgccttaggagtagcaaaatccggttctcccgtactcaaattaacaacgtcgatgccggccgcctgcattttttttgcctcagttgaaactgctaatgttgctgatggactaacttgattagcccgcttcgaaaatttcatcagattactccttttctagttcaatcaataaatctcccgtctcgatttgcatttcaggggtagcataaatcttcttaatggtcgcgtcgaaaggtgctcttaacgcggtctccattttcatcgcctcagtgacaattaagttatcaccttgctggaccttttggcccgcttctacttgaacttcaatgaccgaacccgccatagtagctccgatctgttcggctttagtcggatcagctttaatcttctttactttcgttacctgcgcattaacatcataaacaatcacttcttcactttgtccatttatatcaaagaaaagtgacctttggcccgcctcatctgcttcactaatttctcgaaggacaataatgaccgattttccgcgtcccaattgtaaatcaatgcgttgaccaatatgcatgccttggaaaaagattggagtatctaataatggtactggaccatattcattttgacgttgaatgtattcggtcatcacatctggatacataataaacgacataacttcttcatcacttgcttggtgacctaaaaccttagttgcctgtttacgaacttgatcaaaatcaactggatcagctaaagctcctggtcgtactgtcaatggagcttgtccttttagaaccaccttttggagttgttttggaaaaccacccgccggttgccctaaatcaccacggaaaaagtttaccactgattcgggaaaacttaattgtcccttatcgttcattaccatttcgggcgtcaaatcattttggaccatgaatagtgccatatcgccaactactttagaagaaggcgtaacctttggaatatcgccaaacatttgattgacggttgcgtacatttccttaatctcatcccaacgcttacccaaatgaactgcattagcttgctggcgcaggttggtatactgtccaccaggcatttcaattcgataaatttcagtttgtggtccatttaattgggtgccaaatccttcgtaatatggtcgaattccagcccaatattcatctagtttttccgctttttgaatgtctaaatctggttgacgctggttattagacaacgcatagtaaagagactgcattgaaggctgagaagtcgttcccgctagcgcagaagtggcaacgtcgaccacatcaactccagctcgtattgcttcagaatataagaaaatgccgttgcctgtagtatcgtgcgtatgcaaatgaattggcacatccagatgattttttaactctgaaattaatgcataagcagcttgtggttttaaaattcctgacatatctttgattccaataatatgagcacctgctgcttggagttcttgagccaaatccacataatatttcaaattatatttagtacgattagtatctaaaatatcgccagtatatgccatggctgcttcagccacttttccattatcacgcacccgttggatagattcttcaagctgtggaacccaattaagggaatcaaagattcggaaaacatcaattccatttttggcagccaatcgaataaattcgtcaatggtgttgtctggataattttgataccctactgcatttgacccacgtaaaagcatttggagcatcgtatttggcatcttagcccgcaattgttggagtctttcccatggattctcacctaggaaccgataagcaacatcaaaggtcgcaccgccccaaacttcagctgaaaataggttaggcagacctttctggacttgatcggcaatttctaccatatctttggtccgcattcgcgtagcaaataatgattggtgggcatcccgcatggtcgtatcggttagcaagacctgcttttgttttaacagccaattgatcatggcatcaggtcccttactatccaagatctgtttcgcattttcatgcggtacttgtgcttcaaaatgtggacggactggccgagttaacactactggattctgcttttctaagcctgggtaaccattgatggtagtattagcaatgtaactcaaaagttgagtaactaccggggtttcagcttttaaatcaaagagttctggtgtctcatccacaaaggttgtcggagctaattccgatctaaaaataggatgatgaattaatttctttaaaaatgggatattagttttaaccccagcaattacaaattcattgagcacccgatccatctttaccaaggcttcgtcaaaggttggcgcatggacaattgccttggtcagaagtgaatcataatgcggagttacaatggctccagcaaaggcatttccagcatccaatctcacacctgttccaccaggtgaacgatacgtctggattctgccgacatctggaataaagttattcattggatcttcagtggtaattcgggcttgaattgccactcccacagcttcaatttgggcttgttgaggaacaccgatttcttcgtgtaatctttgaccttcagcaaccttaatttgggtttgcacaatatcgattcccgtgacttcttcggtaactgtatgttcaacctgaattcgtggattcacttccataaagtaaaattgattaccttctaccaaaaactcaatggttgcagcgttactataattgaccgacttcaataattttaaagcagcttttcttatttgatcacggacggaggcagaaattcccactgctggagcaaattcaatgattttttgatggcgtcgctgaatcgatgaatttcgttcatacaaatgaaccatctcaccgtgttcgtctgcgaccacttgaacttcaatatggattggatcaactaagtaacgctctaggtaaatctcatcgtccccaaaagatgaagaagcttctgactgagccatcttaaatgcctcgcgcatctcttgttgatgatgtacaatccgcatcccttttccgccgccccctgccgctgacttaacaaatataggatagccaaattgccctgcaaaatttagcgcatcatcgacatctttaactggtttttccgttcccggaatagttggtacaccggccttaatggctgcatttttagcttgtaatttatcaccaaacatttctagtaattcgggtcgaggtccaatgaacttaatcccagctgcttcaactgctcgcgcaaatacagcattttccgacaaaaatccatagccggggtgaattgcatcaatattattttcttttgcaatacgaataatgtcatcaatatttaaatatgctccaattggatcactatcttcaccaacttggtaagcttcatctgctttaaaacgatgcatagaaaattcatccgctttagcataaattgctacagctgtttttccgagttcatgcgttgcccgaataattcgggtcgcaatttcgcctcggttggcaattaaaatacggtgcatagtggacctccctaattaaattgttcgtgatttaatcaatatttaatgttcattgtatcaaattaaacgggtcttgttgtgtaatttgctaaataaaaaaactaaacttagaatttgatgaaaattctaagtttagtttttaagcatgagtagctgctttatttttcttaatagcatccttcaaaataaacggtgcaatgagggtaaccaaaacaatcactaatacaatcgctgaataataagtttcactcattaaatgttcaccataaccaatttgtaaagtaattagcgccatctcgccacgggaaatcattccagctccaattaccccactactagttaaatcaaatcccgacattcgagctcctaatccacaaccaaataatttggtaatagtggctaaaatagttaataccacaattagtcccagtacagtttgaagtccatcaaaattcattgataaaccaacactaacgaagaaaactggaataaagatagcataaccaattggttcaatgctctcattgatttcatcatcttcatcggttaacgaaacggctactcccgcaaaaaatgcgccgatcgctccgctcaaaccggctacatcagccagccatgctaaacctaaacaaataataatcgacatcactgggcgcgaagccgtaataaacagttggtctgaaaggcgcataagcatcggaaccacccattttccgatcacgtatactccaatgaagaataacacttgataaaagatggccatccccacgtttgaattggatcccgatttagaactagtcaacgcaatcataacacctagtaataaaactccaataatatcatcggctacagccgcccccaaaatggtggccccctctttagtatttagggtgtgatattcctttaagacttccacagaaatactaactgaagtagctgaaaagatgaccccgatgaatagtgcttccatcggatggactccaaaaagaaggctcgcgccaccgactaatataatgggtaaaactacccctaatatcgcaacaaccagcgccggcttgatgtattttttcaacattttcagatcactttctagtcctgctagaaacatcaggataattaccccgatttctgaaaacactgatatcaattcgtctgaatgaataatccctaaaattccaggccctaaaataattccgaccaataattgtcctacaactgcaggaaatcccattcgttgagcaaaatgaccagctaaaagggtcagtactaaaattagtacaagtacgcccacgaactccattaaaccacgttcctttcaaaataaagctaaattataacaatcactaattaagtatactacatatagcctaaatcactggcttccgtaggataagctaagatttgattgttgatttgatctactaatcccccttgattaataatcatcgttaaatcattaattagatgttctgcttcactactcattgtaattgcaccaacaatttttccactggacttttcatgaataacactaattttagcgaacggatcttgtaaacgccgataagtaaaccactctgtcatctccgctgtctttatttcatattgttctggatgttgctgcgcctcatccaattcaactcctaccttagccaatttaggcattccgtatactacggtagggattgctggataatcaatcgctgcttgggttgcattcgttagctttttagccaaataacgggcttcaaatccagatactggagtcagtttaggaagcgccttggaaacaacgtcccccatcgcatagatattatcaaccgatgtttccaaatattcattaactacgattccaccacgatcagtttgtacaccaatcttttctagatttaaactatcatcattgggttttctcccagctgtaacaaaaacctgatcaacgatttgcttgaaaccttgtccatcactcaactcaaaccgttcatccttaggttctacccgctttaaatcaattcctaagtgaacttcaactccttgagttttaagttgatcgattaagtcatcgacatatgctttaggaaaagcttttaatgggcgttgattatgatgaataatgtgtaccttagcccctgcgccactagcaatcatcgccaattcaaatgctatatatcctccaccgaccaaggccagttcatttggtagatgatccatctttaagaaatctgtactagtctgcatcatctcttgattttcaatatttgttaatcgaccagggcgttgtcccgttgcaatcacaaatttttcactggtgatggttgtttgattgattttcaaggtgtggtggtcaataaattcagcatgcccatcataaacatcgatttgagcgtccgttaaacctgaacggctgcttttagaaactggatctgtaaatgttttttcaaattgcattaaagccggccaatcaatttgagtttcatttttaattccattaccaagcaaatattgattttgttttttagcttcaatcgctgctaatagaacctttttagggtcacatcctcgattaggacacgttccgccccaaagattttcttcaacaactgctacttccaaccccgcttcttttaaaggataagctaatcctaagccaccaggtcctgctccaataatcacaacgtcatactttttcatttaatttacctcccttaatgtttggtttcacttaaatacctaaataatgatgctcggtcaacccaattaaccgttgatttatcttcatctactacttttaatatttctacttcagccattgctgcaaaagctttttctaaagtatctttagcgttaatttcagatattggttctgtcccatgcggttctggaatttcaaagcccgttcgaataattttttcaataggtgtcttatatagatttttacccaccgtcgccgagaagaaattctccacaaatgcattttccggattctgtgcaatttcctttggggtggcgacttgcaataatttaccatcgttcataaccccaattcgatctcctagttttaaagcttcatccatatcatgggtaacaaatataatcgtattcttcaacttttgatgtaacttcaaaaccaaatcttgtaattgatttcgcactaatggatctaacgcactaaaaggttcatcaaacaggacgactggtggttctgaagcaatcgcccgtaaaatcccaatacgttgctgttcaccacccgaaagatcactggggtggcgatttcgatacttttcaggatcaagatcaacatcaccaaggagttgatctacccgtctttttatatcctcttttttaaagtgtttcatttcaggaattaacgcaatattttgttcaacggtcatcgtgggaaacaatgcaatttgttgtagaacatatcctacattcagacgcagctctcggagattgtaatctttaatcttcttaccattgaacaagatatcgccttctgtttgaacgaaaagttgattaatcatcttgagtgtcgtagtttttccgctaccggaagttcccactaggacaaaaatttcaccttcttgaacttcgaaactaatatctttaattacgctatgatttccaaaatcctttttcacatgttgaaattcgatcattgttttagccactattttccgtctcctttcaacaaaccttttttaactaagtattgatgagccactacatcagctgatttcttttgtacattaacttcataattcatttcttgcatttccgattctgaaattttaccggctaaccgattaagtgctttgacgacttgcggatgtttattggcaaagctcgttttcattaagggcgccccttgatatggagggaaaacatgttgatcatcttttaaagtcgttaaattcaattgctttatttgactatcggtagaataagcatcagcaacattaatctgtccgtttttaatggcggaatagcgtaaggaagcctgcattgaacgaactggaaaatctaattcgtaagcctttttaattcctacccaaccatctttacgatgaataaactctaaggtcatgccaccttttaactgattttcaatattttttaaatctgagattgtttttaaatcatttttcttggcaaaatcctttttaaccacaagggcattcgtattttgatatttcatcggttgcaggtaatccatttggaactgttgtttcaataatcgttgggcatctaagtaagtttgatgcgcactcgttttttgagtaggggctttcttcaccaatgtttctaaaaccgttcctgtaaattcaggataaatatcaattttatttgattttaaagcgttgaataaaaaggtggtttcaccaaaattttgtttcaataccactttagttcgtggactttcttgctcaattaaatccttatacatattaataagaatatccggttctgctcctaattttccggcaatcgtaatggtttcagttttaggcattaccaatcgcgtgatagaaatcccagctgccccgatcactaatactgctaaggtgataagcatcttcttaattgataaacgctgaacgacgctgatgagtgcacttaatataatcgctaaaagggctgaactaattgccccaactaaaattagttgtgggtcattccggttgatcccgagcagaatgaaatttcccaagccccctgctccaattaaagctgctagcgttgccgttccaataatcaatactagtccggttcgaattccagaaataatgactggcatcgctgttggtaattcaactcggaaaagtttttgtgaacgacgcattccaaaagcgtccgcagcttcctctaaggaaggatcaatttctgtaattcccacatatgtgctttgaaaaattggtaacaaagcgtaaattaccaatgcaattacggcgggtacactgccaatccccactaaaggaatcaataaccccagcagtgctaaagaagggattgtttgtaaaactcccgtgacttgtaataataattctgcaactttacgatgatgggtagcccaaattgctaatggcatcgcaattaaaatcgcaattaataatgatagaactgaaattccaatatgctgaagtagtgcctgtcctaactcacctttttgttcagcaaaagtttgtattaatgctctcatcttctcaacttctttacgcttatttaatatttaaattatctcataaaaaaaatggtgtccctaacaaaaagcctggttagagggcaccacttagttaaaagttggtttttatttcagctggttcagttttgacgatgacctttccattgtggatcgaatacaataattctttccgttcgttaagttcattataaaaattatcagtgttaaaaattaaacaattagctggttttccaacttcaattccataatgatctgtaacatttaaagttttggcaccgttattagtagttaaattataagaattcataatttgcgaatatcccatcaattgagttgcatgaattcccatatggatcgaatctaacatgtttccgtctcccattggataccaagggtcttttatatcatcttcgccgaaggaaacattaacgttattttccaaaagttccttaacgcgggttaacccgcgtcgttttggatacgtatcaaaccggccacccaggtgcatgttaattaatgggttgcataccatattaatattggacatctctaaaagacgcattagcttataaacatacgcatcgttatatgagcccattgccgtagtatggctagcagtgactttattttttaaaccactttcataagctaaggtagctaagacttctaggtgacgtgaattaggatcatcaatttcatcacaatgtacatcgataagtttgtcatatttttcagcaagctcaacaatatactttaaggaatccacgccgtagtcacgattaaattcaaaatgcggaattgctccaataacatcgacgcccatttcaaccgcttgtttaatcaggtttttaccatttttaaacgataaaataccttcctgcggaaaggctaccaattgcaattccataaagtcttttacttcatcttttacttctaataaagcttctagagctgtaaaactaggatcggtagtatcaacatggctgcggacaaattgaataccatggctagcttgcttttttaacgtttgaatagcacgttctttagtctcttttttagttaaggtttgtttgcgttctgaccaaatacgaattccatcaaataaagttccagtttcattccattcgggatctcccgctgttaaggttgcatctaaatgcacatgtgaatcaataaagggtggtaaaagtaatttgccattggcatcaatcaccacgtcatcagacgcttcaagatttttacctattgctttaaaaattccattttcgattctaacatcttttacttcaggatcattttcgatatgaacgtttttaattaacattgctgttcctcttttcaaactgcataattagccaatataaaattccaataataatcattacaatgaacgttgccccagtataggtttgaacaaagtccaatttctgtaataagctgtaaaaaattacgcctactaaccataaaataaaagccgtccagtggataccatttttataccagtatcttccgtttggatttcccaattccataggatcatatttctgttttgaaataaggaaataatcaaccaccataatactaataatcggtcctagaaccatacctacatagtccaagaaagcggtgaaggtttctaaaaagctaccatagaaaaccggtataaaagttactaaggttgcaataaccgtggtaatgagaagtgactgttttaaagttagcttagtgaacatattgtttaatgctgaacccgctgcctgaatattgacggcattggccgtcatgctagtcagcataattacaatcattgcaatgagccctaaccctaatctattagcaattgtacttggatcagaattattaggatcgtacacgcctgaactaattgcaatacttattgtggcacttaatccaataaatgcaaatccgaaaacacctaagtttgctcctagaaaaggtgcggtggtcgctgtaacagatttcttagtaaacctagtaaaatccgcgccagcagtcacccacgctaaattaaaggcggctaacgtgtccatggccgtcccaaaccccattttaagatggcttggaactttccaagcagcgatttggttaaaggatacatctttaaaaactactattgattcccaaatcacaaagataataactaagataatcccaattcgttcaataatttgaatggatttctgtcctgaaacaatactaattaaatgtaggatactcatcactgcaattcccataatcaatcccagatttccacccggttgaccatatacaggccatcccaagaagctgtgcaaaatatatgatacagaagtcgcagcaataaaagtattaaccgctgtccaaccaacaaattgtgtcaaattaacaatcgaaggaataatgctgcctctaattccaaaagaagcacgtgacaacgccattgttgtaactccagttttggtgcccatataaccaactaacattaagaatatgtatgaaatactcgaagctaaaattaaggctttaattccgccccagaatccacaagcagcaataattccaccgatgaaccaggttccattgttagcattagcaccaacccaggttgcaaacatatcccaatatgtcatatgtcgatgtttcttatcaatactttctacttggtactttgtattcattcgcacagttcctcctagtattttttacacattttaaaaaattatactagattcactgtacacaatcaaagatgaattggtttaaatttagctttcaaaacaaaaaagaggatacccatgataataatcgtggtatcctctacgtattaaaaatttatttttaagccactagtcggacttgaaccgacgaccccttccttaccatggaagtgctctacctagctgagctatagtggcatttatcaactaagatagtatatcatatttatttacgctgtaaaaccaaaatatgccatgtagcttaaatttttagacacaaaaaaagaaccttccaactttcattactttagtagtatccctttttagttaaaacaaattataaattcaattatggatcttaactccaacgattttccttagaaggcaagatcattaaaataaagaaccagattgtaccgattagtgggatgatttcaattaaaatccaccagccacttcgatcggtgtcatgtaaacgtcttactttaagcgtccacatacccagccaaacgatgaatgcaatgattttagaagctagattaatattcaaatcacttagattgtagatgtcttcaataggatgaccagtaatagattggataattgcgatgatgattacacctaaaatataattgataataactggccaccagtagtcgggacgattggcagtacctgaaaaattggtgatattatgccagaattttttatatgattcaaccatcaatatgtcacctccaatgcaataaacagcttttaaagacttcagtatttagtcataatgtagtttttattacattttagtatagcaaaggtagtcaaaatgtctaataaagtgaatgtttaataatataattggcaaagataatgctgaatttagaaataatcctacttgggatttattgtttgattaagaagggtatattaggttaatgctatgggaataagaaattagaagcgaggaaacctctagaaatatgttagaatgtagaatgaatgaaaattgagaagcattgtgcttctgcgaaggactgtccgtcgtttttgacggtcagttttttaattactaattggaagataattaattgtagtgttggcccttacggaaccctgatatattgatgtcggttctatggactaatgtacatatattatgtaaactagaaattggagtggaatttaatggagagttggctatttttgattggaatctttattgtggcgttattaggcaaaaatcaatcattaattattgctagtattgtagtactatttttaaaattaataccgtactcagataaaatttttcctttattaaataaacaaggaataaactggggggttacgattatttcaattaccattttagttccaatagcaactgggaagattgggtttatggatttagttaattcatttaaatcaccggtgggctggatagcagtagcttgtggtatcttggtctcactattgtcgtatcagggagtaggcttcttatcagctagtccagaagtgacagttgctttagtaatgggaactatcattggggtagtgtttatgaatggcattgcagctggaccaatcattgcgtcaggaattgcgtatttgattattcaacttttacaaattcaaattaaataaaaatgggtgaaataaatatggatacactattaggaaaagtcgaaaaaggtaaagttattgatgaaaatgatgattattattttgttcaattgtcagatggaaatgcctatcgacttgataaaaaagaaattaaaaaaccactgaagaagggtagtttctttactggatttacttatgaaaatgcagatcatgaccgccaaataacacgtgagacgccacgagcaactgctggcaaatatggttggggaacggttgttaaaacgcgtaaagatttaggagtcttcgttgacattggtttacctaacaaagatattgttatttcgttagatgaattaccaacagaaacaagtatttggcctcatactaatgatcgtattttagtttgtctgtctgtagacaaaaaggaaagaatgtgggcacatccagctgactatgatgtttttaaggcaatttctgctcgagcagataaaacaatgattaataaaaatgttaatgcaacggctttccggttaaagatggctggttctttggtattgactgataactttttgttaggatttatccatgcttccgaacgagatcgagaaccacgtttgggcgaacaattaaatgcacgggtaatcggggttcatccagatggaacgttaaatttatcattaaaacctaggaattatgaggctctaggtgatgatgcagcaatggttttagccatgctacaacatacccaagaccaaacgctaccatttaatgatcatagcaaaccagatgcgattaaagaacgttttggtattagtaaaggacgtttcaaaatggcattgggacatttgcttaaggctggtgtaatccaacaaactgaagatgggattgttttaaaggagaaatagtcatgaatgatttaatcaatgactatttacattctcttaaagtagagcgaggcttatctgataatacaattattagttaccgccaagaattacgtcacttgaataactatttgactaaagaaaaaattacagatataaaaaaaattgatcggtatacaatcttagattatttagatgagctcaagaaaactggtagggcaagaagttcttcaattcataccatttcaagtttaagaaagttttttaagtacttattgattgtggataagattgatgttgatcccatggttaatattgatccacctaaaagagctcaccatttgccttcagtactaacgacagcggaagtagaaaagctgttgcaggttccaaatacaaatgaaccacttggaatgcgggatcgaactattctagaagttatgtatgcaacaggattacgagttagcgagttaattacattgaatttaaacgaactccatctggagatgggactaattgaaacgattgggaaagggaataaaaaacgaatcattccaatcggtgacgtggcgattaaatggcttaatcgatatattaatggaccgcgtagaattttattgggtgataaaaagtacaatgaaatcttcttaaaccaacatggacatccattaacaagacaagggatttggaagaatcttaaagctcaggttaaaaaagctggaattgaaaaaaatattactccccatacccttcgtcattcttttgcgacccatttgttagagaatggagcagatctcaggattgtccaggagctattaggtcatgctgatatttcaacgactcaaatttacacgcatattacgcagcaaaggttggttgatgtatatgacaaatatcatccacgagcctaaagataaaggagcaacatgttagtaaaatattcggattcaaaaagacaaattgcgatgggattattgtcgactgttcaagcatttaattcaattgatgtagtacagttggtcttagagcggtttactaaaggaaatcgacagatttatttagagcgaaaagatggaacttatattggaatcgtaatgattatcttagaagaagagtgtcttgtagttgatcgcatggcttttattgcaaacgaggaaacagtattcaatgaaaatgaaattttaagatcattaacttctatctatccagaccggcgtttaatggggtcgttaaaaactagcgcaatgattgaaagattcgaaatggggcaggtaaatgaaagctgaaaattataccctaccaaacgttaagctagctgaatttgagggaccgctagatttattattacatttgatacgaaaatcacagatgagtatttatgatataaaaatatcagaaattactgcccaatatttacaatacttacattcacaagaatcattagtgttaaatattgctggagagtatctagtgatggctgcaaaattaactgaaatcaaaggaaaattactactaccacatgatgaagaagtgattgaggaagaagatccacgtaatgacttagttgatcaacttttagtttatcaaatgtttaaggaagcttcggaaggcctaaaatcacttgaaaaagaacgacagacctcgtttacacgcccagaaatggaaattcctcctaatgaagctaatcgcttagctccgggcgttaaaataagtgacttacaattcgcacttcagaaggttttagcgcgccaagcgctcctagaacccacttatagaaccgttaaagcagaagaagtcactcttgaagaacgaatgtcagaaatcaaaaaacgtatttttgatttaaagcaatgctgttttgaagatttatttattggacattttagccgagaaacattagtaacaacctttatggcaattttagaactagctaaaaatcatcaaatcttacttgaacagccagcaagaaaacaatcaattttaattaagttaggtgaagtttaatgaataatgagcagaaagtagaagccctactttttgtagcaggggctgaaggaatttcagttgaagaactatctaatttcacgggttatgctaagcctgctatactaacgatgctagataatcttgaaaaaaattacgaagttaattctaaaactgctttgaagctaatccaaactggtggtacttacaaactagttactaaacctgagttagcatcgattttagaaagatattttgatcgaaatagtcgctcgggactatcgcctgcagcattagaaatattgtcaattgtggcttatcgtcaacccataacacggattgaaattgaccaaattcgcggtgttcaaagtggcacgactttacagaacttagtacttagaaacctagtgaaagtggttggtagacttgaagagcctggaagacccaaaacgtatggtacaacagatgagtttttagattattttggtttagaggatattaaagatttacctaaacttgaaaaagttggagaagattcagaattagacgatagcgatttatttttacaagagtttgaatcaaaaatgaatttaaataataaggagaaataaatggaagaagaaagattacaaaaagtaatggctgaagcaggagttgcttcaagacgaaagtcagaaaaattaattactgaaggccatgtacgtgttaatggtaaggtgattaaacagctaggtacaaaagtaactgcccacgataagattgaagttgatggtgttcctcttcaacgagaaaagatggtttatttcctattaaataaacctcgaggggttattacatccgttagtgatgataaaaagcgtaaaacggtcatggacttttttcctgacgtagttgaacgtatttatccagtgggtcgtctagactatgatacttcaggtgccgttttaatgaccaatgatggaactttagcaaatggtttaactcaccccaaatttaagtttgaaaaaacatataccgcaaaagttaaaggaattgttaatagtttagatttaaagaagctagaaaatggattggtaattgatcataaaaaaacagctaaagctaaagcacacttaattagcacggatgatgaaaagaaaacttcgattgtgagcctcactatccacgaagggcgtaatcatcaagttaaaaatatgtttatggcagttggtcacccagtccaaaaattacgccgtgatagttactcatttttaaatattgatggagtgcaatctggaaaatggcgtgctttgaaggttaatgaaattagtcgtctaaaacgtcaaattgaaaaatgattccagaagatgttttagctttttttgatcttaagcaggggcgccgtccgaaggcaattttgaatgtattggttggtaaaatgacggtttcggccttattttggggcttagaatacgatattttggagtacctaaatttctggaaaacaattgatacaacctcttttctagaaaatgttgaccgagctgttgaaggtggttttttagccaaaaaggatgagttgatttatttgacggaggcaggacaacaaaagcaattcagttgtacgactcctacgccttttattaaaaaagttcggctcgatgaggcaattaatttgttgctattagctaaccaggtaatttccgaatttagttttaaaaacaatcgttatatcccagttagtgataatcttcgaattaatgtgatcttaaagaattggtttaagcgacttaagtcaaaaaaccatcatacgacagaccttgttcaaaaatatacgcagggtttagatgagcttttaagtcaattacaacagcacgatgcagacatcttgcttagttatcttcccaatcatattgatccggggtggactattgatcaactagctcaggcatttggaatcagcaaatttcaaatggaacttaaagttaggttgatttttagcaagattattagtgatgctgttttaacaaaaacagcaccgtttgttgatttattaaattcaaccattaaagaaaatgttatgccagatagcacttatcaaacgtggcaattaattcgacaaggtaaaacggtggacgaagttgcacgtttgaaacatgttaaaactaataccgtgaaggaacacatcttgatggcagcaattttggattctaattttccatttgataagtttgttagatttaattttgagattgggaagcatcctacagaagttgactttagaagtatccaaagccaaattgcagatattacattttttgattttaggctaatccaaatcagaaaaattaaggaacaacagaataataatggtaacagataaaaaaatttatcaagtcttacatgagaaatttaattttactgagtttaaaacgggtcagttagaaattttacataaactttttgaccatcaccatacattggcgattttaccaacaggagctggaaaaaccttaatttatcaaatgtatggttttttaaatgagggctccgttattgtggtttcgcctttattatccttgatcaaggaccaaatcaaccggttaagattaagtggggaacgtcgtatagcagaaataacttctcaaatagattttatggagcaaaagcaaatccttaacaatttagaaagatataaatttatttttatatcacctgagggattgcagcgacctgatgttcaagcagctatgcaacgaatagagatcgacttatttgtagttgatgaagctcattgtatcgttcaatgggggaagtcgtttcgtccagactacttaaaaattggtcggatacgaacgcaattaaacaaccccctaacattgatgttaacggccacagctggaaaaacaacccgtgaagaaatcgttaggtatcttaatttgaaaaaaggtgaggttgaagaatatattagttctgtcgatcgctccaatatctatcttgattttttagaagtcgaaagtagaagtgacaaaggtgaaaaacttttagatttacttgatgagttaccaggggcaggaataatctacttttcaagtcgcaaagttgctagccaagttagcgaaatgattaataataatcttactcttacttcggctccatatcatgcagggatgacagactatgaccgttttcaagttcaaaaacagtttcaacaagatcaagtcaatgtgatttgtgctaccagtgcgtttggaatgggtattgataaagctaatatcaggtatgtaattcactatcatttgcccggagacattgaaagttatgtccaagagatcggccgtgctggtcgcgatggacaacagagtgttgctattatgttgtatgcggctggcgacgaggtaattccttcaattttaaatgatattgaaattccttctgaagcaatccttactgaaaatcttgaacgcagtggtatagatgaagagcagaaagaattaattaaatattatcaagaaaatgggttaactcctcaagaattaacagagctatttaaaagacaacaattgcaaaatgaacagcaaatcttaagaatgttaaaactcattcaaacggaggattgtcaccgtcaatatttgctacaatattttgatgagggcttcaaaaaacaccatgatttatgttgtggttcaatcaatactttcgaaaaattaaagttagaagctaatttaacaattaaaaaaatgcaagttgaaccttggaaatcgagattaaataaaatttttgcaggaatatagcgtaattttcgtggtcattcaaattgaattattgtaaaatacaatttattggtatgtagtaggaggataaacatgaacgagaaaaatgatgagaacttaaaggatgagcaaacaccggagaattcagatcaaaaaccaagtagtgaagaaccaagcgctgatcaacaggcaggcgccgaggagtctgccactactggaggacggggagaattccataaaaataaaaagaaatctaagaattttgctggatcattaatttgggtgattgttattttagctatcgcgtcgctagcttattacatgacacaaaaacaagattttcaacagaagacggcgaatacaacaactacacaggtagctaaatctagtagtgataaaaagaaatcaagtaaatcaaaggcttctaaagaagaggatgacaaatcttcgtctatcgctaaagctgaatcagagtccaaggctaaagttaagtctgaatcagaatctaaagctgcagcagctagtgaagatgcaaatttaactagtgaagcctcttctgaggtaaccagtgagagttcaagcgtagaacaaagtgatgccacaagtagctctagtaccgatggcaacgcatcttatgcaactgttcaatctgggcaaggtatgtatcgggttgctgttaacaatggtatctcggttcaaaaattaatggaattaaatggtttaacaagtagttcagatattgaaccaggacaacaacttagagtaaggtaggttattagtgtattcatgaataataaatatcaaattgcaattgatggtccggcatcagctggaaaaagtacagttgcaaaaattgttgcaaaggatttgcaatatgtttattgtgatacgggagcaatgtatcgagtggtaacccttaaggccattcaaaatggtattgaccttaacgatgaaacaaaaattagtgaaatgcttaatgatacggatattcgcttcgaaccaggtgagccagttcaaaaggtctttctggatgggaatgaagttacggaagatattcgccaagccaacgttacgaactctgtgtcaaccatcgctgctcaaaaagcagttcgagaagttttaactaactggcagcgtgatcttgctaagaatggtggcattgtaatggatgggcgcgatattggttcagctgttttaccaaatgcagaagttaaaatcttcttaattgccagtgtccaagaacgtgccgaacgtcgttataaagaaaacatagctaagggtatggaaactgatttagagcaacttaaaaaagaaattgaaattagagaccataaagactcaactagaaagatttcaccattgacaaaagccagtgatgcaatcgaggttgatacaacttcaatgtcaattcaagacgttgtaaatgaaatattacgtattgtagaaaatgcatccaagagaaagtagcaacaattactagcaattggagcagtttttcgatattatatatgtataagtgctgtaaaagggggatttattcggatggccgaaaatgatgttaatcaaaacagtgatttactcaacgcaattaatagcgttgaagaagtaaaagttggtgatgtagttaccggtgaagtattggatattgatgacgatcgtcaagtgatcgtaggtattcaaggtgctggtgtagagggtgttgttcctttacgtgagctatcaactcaacatatcgataatattagtgatgaagtaaaaattggtgatgaactagaacttgttgttatctcaaggatcggtgatgacaaggaaggtggaagttaccttctttcacgtaaacgtttgttagctcgtaaagtatggaaagaaattgaagaaaaagctgctaataatgaagaacttgatgtccctgtaacacaagttgttaaaggtggtttggttgtagatgctggtgtacgtggatttattccagcttcaatgatcgaaaatcgttttgttgatgatttgaatgcttacaagggtcaaactcttaaagttaagattattgaagttaagccagaagacaaccgtttaatcctttcacacaaagctgtattaaacgctgaacgtgaagctaaacgcggtgaagtacttgcctcaattaaagaaggcgatgttgtaactggtaaagtagctcgtttaacaaactttggtgcatttgttgaccttggtggaattgatggacttgttcatatttctgaaatttcataccaacgtgttgacaaaccttctgacgtgcttaaagccggtgaagaagtgcaagttaaagttctttctgttgatgcagaaaaagaacgtgtttcactttcaatcaaacaaacacaaccaggaccttgggacaatatcgaagaaaatgctccagaaggtgctgtattagacggtaaagtaaaacgtctaacagatttcggagcattcgttgaagtattccctggcgtagaaggtttagttcatatttcacaaatctctcacaagcacattgcaactcctgctgacgttcttaaagaaggacaagacattaaggttaaagttcttgaagtacatccagcagaacaccgtcttgctttgtcaattaaagctttagaagaagctccaaagaacgaaaagaaaacggaagctcctgcagcagactttagtaaagatatgcctgaagaagcaactggattcactcttggagacattattggtaagagcttagacgattcagaaaaataaattataagtgttaggattaataatttaacatttttcccatgctagattatacctatcgactcagttagagaggccttggcggagaatgatagtctgtccaagacctttttaatttgtaaggaaagggggctaattcaatatgagtaacccaaccgtagcaatagttggccgaccaaatgtcggtaaatcaactatttttaatagaattgctggagaacgtatttcaattgttgaagatactccaggtgtaacacgagatcgtatttatactcatagtgaatggttaggacataaatttaatttgatcgatactggtggtatccagattggtgatgaaccattcctagaagaaattaaggatcaagctgaattagctattgatgaagcagatgttattgtatttcttgtgagtgtacgtgagggagttagtgatgctgatgaagctgttgctaaaattctctataaagctgataaacccgtcattttggccgtcaataaagtagataatcccgaattaagacaagatatttatgacttttacagcttaggtttcggagaaccgtttccactttcaggaagtcacggattagggcttggagatttacttgatgaagtaatttctaaattcccagaagataaaaatgaagaagaggacgacgccattcgctttagtttgattggtcgccctaatgttggtaaatcatcattagttaacgccattttaggtgagcaacgggtgattgtctcggatattgctgggacaacacgtgatgcaattgatacgcgtttcactaataatgaagacgaatatgtgatggtagataccgctgggatgcgtaaaaaaggtaaggtatatgaaaataccgaacgctacagtgtgatgcgtgctatgaaagccatcgacaatagtaatgttgttttagtcgtgctgaacgctgaagaaggcatcagagagcaagataagcgtattgctggatatgcgcatgaagctggccgcggtatcataatcgtggttaataaatgggatacccttaagaaagataaccatagcttatctaactttgaacaggctatccgttcagaatttgcttacttaagttacgctccaatcatttttgtatcagcagttactaaacaacggctctcacagcttccagaattaattaagcgagtagataccaaccatcgtcgtcgtatccagtcttcttccttgaatgacgtgttaatggatgcaattgccgttaatccaactccaagtgataatggaaaacgtttgagggtttattacggcacgcaggttagcactgaaccacctacctttgttgtttttgtaaatgatcctgatttgatgcatttctcatacgaacgcttcttagagaataaaatccgtgaagcgtttgactttgagggaacacccgttcatttgatagaacgtagacgtaaatagctaagattgtattataagaacgctctaaaatatgaaaaagcttgtcacgtcggtgtttgtatgatatatttcaagttgaaataatatcagagtattgtttcaacatttttgatcctttcagaaatgacaaaacatttcgttttgataaataattttcaggaggtgaaatacatggcaaacaaagcagaattagttgataacgttgctaaagtaacaggtttaactaaaaaggatgcaaccgcagcagtagacgctgtatttagctcaattcaagatgacttgaagaagggtgaaaaagttcaattaatcggttttggtactttcgaagtacgtaatcgtgcagctcgtaagggccgtaacccacaaactggtaaagaaatcgaaatcgcagcaagtaaagttcctgcattcaagcctggtaaggctttgaaggacgctgttaaataagcggttttctgaactttagtcagcatagctctgttatgctggctttttgtttgcctgtaaaaatttatggataataatgagtcatattcacaaaaaacattagcagcacttgagtcggggcagattgaagaatcgaaccgtctatacagctgggctcttcgaaaagatgacaatgaaacgctatataatttagctggagaattatttgcattaggatttgatggaaaagcacttcgtatatacgaaaaattgatcgaagaatatcctaatgatgatgaactgttagtcttggcggctgaaattttaattgatcaaggtaaaaatgatgcagctctagaaaatttagatcaaatttcgcctgactctgagttttatgtatcatcattaatggttcaagcagatttatatcaaaccgaagagctgtatgaggtttccgagagaaagttagttgaagcaattaaactagccccagaggagcctgctatccaattagccttaggtgagctgtattatacaacgcaagactactcaaaggctgtaaactactatctagggttaattaaaagtgggatcagtgaaatgtcccaaattaatattgttgaacggttagcggtctcttatgccgcttatggaaagtttgaaaaagcgattgcctactttgaacaaattcatgaagaagatttgacaccagatattttgatgcaagaaggaattacttatcttcagttagatgaaaatgagagagcacaagcaactcttgaaaaagtaattgaattggatccttcttatagcagtgcttacccatatttaattaattcttatcaaaaagatgagcaatgggacgaaggattgattgctgcccaagagggcttggcggtcgatcaatacaaccctgagttgtatcttcaagcagcagaaatggctgagcatgctttagataatgaattggtggaaaaatacctgcggaaggcaattgaattagcacctgaaaatacagaaggtatgattcgcattaccgatttttataatcgaattggaaaatatgatgaaactttacgtttcgctagtgacgatataactgatgctcaattaaattggaatttagctttagcatattggaagacagatgattttaaaaaggctgctagtcactttgatgcagcattgagtgatttaaaagatacaactgcctttttattggatctttaccattttcttagggagagtggacagttggaacacgctgtcgatatcgcacgtaaatacgtaaaattagcaccaaccgatgtcgatatgcaggatgaattagaacagctggaggaacaaggttattaataatttaaatgataaattcaaagtgaaaagttgggcgcctaagttcaataaaaaaatggttgaagtgatgcgtaaaaatcaatttaaatctgataattcagaggattttaatgacttcaaacaaattgattttaaccaacaacaagatttaatgaagaatgaaatctctaaaaaatatgaaattaaagtggttactagttttaatgagcgtataatttttagcgtaattggacgtaacgaacataatgaatttttttatgcaattgataaaaatgttcaaaatgaagtttcccttgaaaagctaagagcattattcgataaataataaaaacagattccgtcaagcgcggaatctgttttttaatatagatttttgttcaagtagttcttgattatcttaataaacgaacattaataataaattcagttgctaattaaccagtttttaactaaaaagtgaaaaaatatggtatagttatatacacataattgaaggagtgagtaaaaagcatgggaaactcagtatatttagcagggcctttctttagtgatttacaaattgaaagagtacgtaaggttgaagagcttttaaagaaaaattctacaattgattcaaaaagaatttttgtaccaatggataatcaatatgatactaaggaatttggttcatttgaatggcaagtgggagtctttgaaaccgatgtgcgtcaacttcgcaaagccgatattgttgtagcaatcttggattatactaaaaacggtgaagaaatcatttcagatcctggaacagtatttgagatcggtactgcctttgaacatggtaatcccgtagcacttgttcaatttgatgattctgacaaaattaatttgatgcttgctagaagtcacactgctttctttaatggtgaaagtattaaggacttggcaacttatgattttaatttgttaaagccggtatattctgatttaacagtattctaaagctaattaaaaaacatcagtcatgtatttaagtttatacataactgatgttttttaattagggatatttcgatttttagcactgggcgaatcgtaggtaaaaccttcaccaatggcttcatggacatcaataatagaagtaaacgcctgaggatcaattcgtccaatgatacgtttagcaacgtttaattcgttaggtccaattacgcaataaaccatttcacgctctgttttagaataggcaccagacatatgaatatagcttgccccgcgctctaactcgtccattaaggcatcagcaatctcttggtttttgctactgacaattagtaaaccatgagcagcataggctcccacctgtgtaagagaaactagacgagaaaatacataagctgctagtagagtatacatcatatgaaggacatcgatgtagcaaagagaaatggttaatacgacggcatctaaagcgaaaagagtatgccccatggcaattccacgccgtttctcgagaatgcgagctacaacgtcggttccaccggttgtaccaccgaaacggtaaacgatcccgctaccaaaaccaccagcgattccggccaggattccggcgataaacatatcatgatgaatatcgagactgatgggtactcgttgccaaacgtataaccaaaatgagagcgcaaacgtcccaaaaattgtgtaaattaaagatctttttcccagaaaacggtaacctatgaaaattaatgggatattaattaaaattgttgagagtgcaggatcaattcctaataaagctcgtaaaattaaggtgacccctgtaattccaccttcagctagattattagggatattgactacagccaaccctaaaccatacagacaacaacctaaggcaatcatcacaaaatctaaaaatcggattgattcatctttttgcataatagacctcctacgtagaaactgaagtacttgcaaatatcataccatagagcggagcaggcttttcaaaaaaatcatacgctggtagaattattaagacgatgttagagtgtgtgcaaaatttttatacttaattcggtaattagttaaaagatagtacctttacttaaatcggattgatgcgcatactaagttaaagaatttattatttaaggtgttacgagaaagtaattcctttgaaacggatgtggaaatggtgcagatagaaaaaatgccccaagaatttgaggacgcccgtgcagtcctacaaaaaatcgaagatgcaggttttgatgctttttttgttgggggaagtgttcgtgatacattattaaataagccaattcatgatgttgatattgcatcaagcgcataccccgccgaaattaaacatatttttaagaaaactgttgatacaggaatcgaacatggtacggtaatggtgattcatgatggcgaaggttacgaggtcacgacttttagaaccgaaagtggctaccaggattttcgccgtccagatcaggttacttttgtacgctctttaaaagaagatttaatgcgccgtgattttacaattaacgcatttgctttaaaagaagatcgaacggtaattgacatttttgatggtttaagcgatctagaacataaaattattcgtgcggtaggagatccacacgaacgttttcatgaagatgccttaagaatgatgcgagcagtgcgttttgcaagccaactagatttcaaaattgaagcaaagacgctgaaggcaatcgaagaaaataatatgcttttaggtaaaatctcagtcgaaagaatcttagttgagtttgaaaaaatgatgttgggtagcaaacccaatcgtggactagaagacatgctaacaactaaattgaatgaatattgcccgggatttaaggaccgttctaaagaactataccagcttacaaaatatcccttggaacttctagaaaatcctgaacaagtttggactatgattgcttggagtttaaaattaactcctcaagaagtaatgcctttcttgaaacaatggaagacatctaacgatttgatcaaaaatgtcagtgcgactttacaagtattaagcatggataaaaatgatcaaaacgaacgtttagcgctgttcaacgcaggtgaagctaatgtagttaacgccgttcgggtagcccaaattctagggatgaatcgtgaggcttggctagatacttaccaaaaccttcaaattaaggatacacatgaaatggcaattactggtaaagagctaattcaaaaaggaataattaagcctggacctcagatgggacaagttttaaaccggttaaaattaatggttattaatgatgaactgaaaaacgagtccttagcgcttttgaatgcagtaaataagttacagaaagatgattaaatatgaaaatactaaaaggtaagaatctaaccaaaacttacggtgaaaagaagctgtttaactcgattaattttgtaatcaatgaacacgatcgagttggactaattggaactaatggatcaggaaaaacgaatttacttaatgccgtttcgaatcttgatcccgctgattcaggaacaattgaaacaccaaacgattaccatattgcatatcttaaacaaagtgaagaaattagtcagtttgaaacggtacgtgaatttatttacagcggggatcaacatgtatttcaagtaattaaacactacgaagaaatcttagaacaatatactaataatccaacttcatcaacgctatttgaaaaatttactaaacttgaaaatgaaatgaatcaactggatgcttggaatacggaaagtaatattaaaaccattttgacgcaattacacgttgatatgctagatgaatctatccatcatctttcgggtggacaagttaagcgaatcgctttagcacaggcattgttagagccggcagatttattgattttagatgaacctactaaccatttagattttgattcaattgagtggctggaaaaataccttgctgattataaaggcgcattactattggttacccatgatcgatatttcttagatcgagttaccaatcgaatttgggaattaagttacggagacctttttgagtacgtcggtaactatgaaaaatatgttgaacaaaaagcggttcgtgatgagcaaaacgaagctagtaaacaaaaagagtacaaactatataagcaagaacttgaatggatgaaacgcggacccaaagcacgtggaactaaacaacaagcgcgaattaaccattttgaaaagttagaccaagctgtacatgcgcctaaagaggttgatcaagaccttgaaattggtctaacacaacaaagattaggtaaaaaagtaattgaaatcaatgacttagatttaaaagttggcgaccatcaaattatgaaggatttttctaagttagttcaggcgggtgaccgaatcggaataacgggagccaacggtgcaggtaaatcttcatttttgaatgcgattgcgggagtattacctattcagggtgggaaaattgaaattggcgaaactgttaaaattgggtattatactcaaaaaattgaacccataccagaagataaacgggtaattaattacctaaaagaagttggacaagaagtaatcaataaagatggtgaaaaaattagtgtcactagtcttttagaacaattcttatttccaagttttctacatggtagtttaattaaaaagctatctggtggtgaaaaacggcgtctatttttaattaagattttaatggaacaacctaatgtactattgttagatgaacccactaatgacttggatattgctactttaactgttttagagagttatttaaaaaccttcaaaggtacagtccttaccgtgtcccatgatcggtatttcttagataaagttagtgaccaattattaatatttaatggaaatgctaaagttgaaaaatatacgggctcgatcagtgactatttaaaacaaaacgtagtacaatcaagtaaaattaaaagtactcctaagtcagttgaacaagttgaagctcctaaaaagaaaaaaaggacgtattcagaagaaaaagaatggcagacaattgaaactgaaatcgaaaagttagaacaaaagtccacatctgtggaggaacaaatgagcgaatgtgctgctgattacggaaaattagcagaattgcaaaaagaattaaatgaaatttcggaccaattagaagaaaaaatggcaagatgggaatacttagaaagtttcgaagaataggggaaatttaatatgcttgaagaacaataccttaatttggaaagatatgttttggaaaatgggcatctcaaaggagaccgtacccaaactggtaccctaagtacttttggatatcaaatgcgttttgatttaagtgaaggttttccattactaacgaccaagagagtcccttttggtttgattaagagtgagttactctggtttttaaaaggcgataccaatattagatatttacttcaacataataatcatatttgggatgaatgggcttttaaaaagtgggttgaaagtgatgaatatcagggatcagacatgaccgattttggtcaccgctcactgactgatcctgaattcaatgaactctataaaattgaaaaacaacgttttacagaacaaattttggaagatgatacattttctgctaaatatggtgatcttggaaatgtttatggtagccaatggcgagcatggaagactagtactggtgagactatcgatcaaatttcaaatgttattgatatgattaagaataatcctaactcaagaagaatgattgtttcggcttggaatcctgaagatgtaccaacctcagcattacctccgtgtcattcactatttcaattttatgtggctgatgggaaacttagctgtcaactgtatcaacgcagtggcgatattttcttaggaattcctttcaatattgctagctatgccttgcttacagaattaattgcgaaagcgaccggtttagaagtgggagaatttatccataccatcggtgatgctcacatttattctaatcatctagatcaggttaaagaacaattggaacgtactccacgtccggctcctaaattgaaatttaaacaagtgcatgacagtatctttgactatgaaccaggagatattgtggttgaaggatatgatcctcatccaaccattaaagcgccggtagcagtttaattttaagtcaatttaggaggaattaaatttgatttcaatgatttgggccgaagatttgcgtcatggaattggtaagcagcaatctattccgtggcatattccaggtgatatggctttttttaagaaaaccactagtgggaacaccgtagttatgggtcgtaaaacttttgattcaattggaaaagcgttgcctaaccgaaaaaatattgttttaagtcatcatccaacctcattgccaaattctgtagttggcgtgggttcattaagtgaacttcaggtgatttttgaaacccatcctaatgaaaaattttatattattggaggaagtcatttatacaatgccttgttatcacaagctgatgaacttctgataactagaatccaaaaagattatcaatgtgaggttttcgcacctgatattacccaaaatgaatttaaattggctagttcagttgaacatgaatcaaccgaaagaaatcctgcatatacttctgaaacatggattagaatttaataaacgttaaaacctcatttattgaggttttttatttatcctccttttcaaaattaaaattatatgatatatttaatctaatttttaatgttaggttatctaacataagtaggagggcatcatggcaaagattaaaaaaactttattgagcatagtttttagcattgtaattttatttgggtggtcagtttttaattcgaataacgtcaatgcggatgagaaagtgtacgagattggaactgatgttacatttccaccgtttgaatttgctaatgatcaaaatcagtacgtagggattgatatggatatcattaggacgattgctaaaaacgaaggttttaaagtaaagattaagccggttggtttcaatgcagcggttcaagcgcttgatgccgggcaattggatggagttattgctggaacaacgattactgatgaacgtaaacagaagatggatttttcggccccatactttaaaactggggtggtgatggctgtaggacaaaactcatccatcaaaaatttccaagatttaaagggcaagcgagttgctatcaaaactggtacagctgctggagactatgctaaaagtattcagaaaaagtatggattcaaaacggttacttttgatgattctaataacgtctataacgacgtgacgactggaaattcagtggcatgttttgaggatcagccggttatgcaatacgctattaaaactggggcaaaacttaagatcgttactaaaccagccaatggcggagcttatggattttctgttaaaaaaggacataaccaagaactattaaagaaatttgatgctggtttaaagaaaattaaaagcaatggacagtataaaaagattgtagctaaatatttaggagcttctgctgttgcttcacaaaaagctcataaaacacaaaatacatttattagtttatggaaacaaaatcaaggcgcattacttggtggattagaacaaacggttattttaacagtattatcaattttctttgctaccatttttgggatattcttcggaatgttaggggttgtcccaaataaatttgctaatggagtttcgactactgtaatttatattttccgtggacttcctttgttagttttagccttatttatctatacgggggtgcctaatttgttaggtgaaaaaattccagcatttgttgctggaattattaccttaaccttaaatgaaggagcttatactgccgcttttgtaaaaggcggtattgaagcagtagatggtggacaaatggaagcagcacgttcactgggattaccatatggaaaggcgatgcggagagttattttaccgcaaggattgaaaattatggttccatcctttattaatcaatttattattactttgaaagatacttcgattctttcaattattggaatacttgaattaacacagacaggtaagataattattgcacgtaatctagaaggatttaaaatttggaccatggtagcactaatttacttggtcatcatcacattactaacgtggctttcaaaatgggttgaacggaggatgaagggatgagtacaaaaatagaagtacagaacttaaaaaaatcttacggtagtaacgaggttctgaaaggattagatttgatcgtcaaagataatgaggtggttgttatgattggtccgtcgggttcgggtaaaagtacttttctacgtacgttaaataagttagaagaaccgaccgctggaaaaatcattatcgatgggcatgatttgaacgatccacgggttaatatgaatcaggttcgtgaaaaaattggaatggtatttcaacactttaatctatttaataatttgaccgtaggcgaaaatgtgatgttgtcgccggttgaattagggaagatgagtaaagcggatgccgagcttgaggcacgtgaattgctaaaagaagtgggtttagaagataaatttaatgctaaaccccaatctctttcggggggtcaaaaacagcgagtggccattgcaagaactctagcgatgaaaccagatatgattttatttgatgaaccgacttcggccctagatcctgaaatggttggagatgtgttagcagtaatgaaaaaactagctaaggcagggatgaccatgattgttgtaacgcatgaaatgggctttgctaaagaagttgctgatcgtgtgatttttatggcggatggtcatatcatggaagaaggaaagccggaagaaatttttggtaaccctcaaaacgaacggacacaagaatttttaaacaaaattttaaacgtttaatcaataaaagggcttgaagtaaaaataatatttaatgaggttaaatattatttttatcaaggctctttttaaatacaaaaattttttgcggaaaagtttgtttatagaacaaaaatttagaatagattgttataattaaaattgtaaatatgtacggggattctataaatgtatatgaaacacgcttcatgtgaatagaactcggaataactatgtaacaaggaaagagtgaaaatatgagtcaaattaaaattgtcacagattcatcatgtggcgttactgatgaagaaattaaaaaatatgatatttcaattgtcccattaagtgtaatgattgatgatacagtttatgtcgaaggtgaaaccattactaatgaagaatttattcataaaatggcatcatctaagtcactaccaaagactagccaaccaccattaggtaaatttgttgaaatgtttgataaattaggtgaagatggtagccaaatcatcagctttaatatgttagaggcaatcagtggaacggtacatactgccgaacaagctgctcaacttagtaaagcagatgtgactgtgattgatagccaattcacggatcgcgccttagcttttcaagttttagaagcagctaagatggctcaagaaggtgccagcaaagacgaaattatccagcgagcagaatatatccgagatcataccaaactttacttaagcgttgttaacttggaaaatttagttaaaggcggtcgtctaagtaagattggcggaatgctgggaggtttactaaatattaagttattacttgaggtaaaaaatggtaaacttgatgtagccggcaaggttcgcgggatgaaagccatgaagaaactttggtcagatatttatactgaaatgcaaggtagtggcaaaatcaaaggggtaggaatttcacatgtagaagcctttgatatggtagaagatatgaagaaacatgttggtgaatttttcccagttaatgatattgttgtacgagagactgttccaattattgcaactcatacaggtatgggtgcgttttgtatcttatattacagtgaagattaaaaagtagggcttagatcgggactaaccgattttggccctaatttattttacagagagaggcattatgaaagtagtcagagaaattttatttagtatcattggtatttcggttatcacgcttttaattttatgggggttgggcttttttaaaggagctaagacaccgtctcaagttgctaacaaagtcgtaccgacgacccagaaaaaagttaaaaatcttaagattttagcattaggtgactctctcactcaaggagttggcgatacaaagaatcaaagtggatatcagcaacgtttagctaagaaaattactaaaaccaaacagataaaaaaggctacgatttacgatgagggcgttagtggcgagcgtagtgatcaaatccttaaacgcttcaaaactactactaaaattcaaaaagaggctgctaaaagtgatgtacttattgttacggccgggggaaatgatcttttccagaatctccagaaagatgttactgaatcacctagtcaagttgccgtaaatgttaatcgtattagtcttacttatcaagacaacttagaaaatatttttaaatatgcaagaaagctgaatcccaaaattaaaattgttatggtaggaatttataacccattttacgtatatttcccaaatgtagtggctatcacagatgcgataaatacatttaataccacggcaaaagccactggtgattatttcaagcatgctacttttgttgatatcaatgcattatcagtgggtcaatataagacgcttagtcagcagcagcgtttaaagaaacaaagtaccgaggatgatattgcggttgttgaaaagagtcaacttgagaaaagtaaatttgatactaaagaaaaaaataattatttatcggatgcagatcattttcatcccaacgacaagggatatgatatgatggcagataagatctttaaggccatggatcgggcaagaattttcaagtaggtgaagaaatgaataagtatatgtatcatttttggaaatggggatttttagtcctgctctccatttttttagcgggcggtatttatgtaacttttaaagcttctcgtccaattcagcaagttgatgaccaagtagttcgaagtagtaaccaatatgatcgaattccaattaaattaaagaaaaatcaaattaatgatttaagtgcagcttatctttctcaatttcaaaaagatgaagactttaattatgagtttaaaattggtcaacgctacgctattttaagcggagaaactgaaattttaggtaaaaagattcaatttgcgttaacgatgattccaaaggtgaccaaaagtggtaatatcaaacttaaagcgcatgggctaacggtgggaacgttaaatttgtcagctaaaattgttttgaaatatatttcacgtaattatcaacttcctaaatgggtaagtattgatggcgatgaagcacttttacgtttgaatcagatcaaaacaactaataaagtcagcttccaagctaaaacaatcgatattgataaaaacgattttcaattcataattaacgttcctaaagccaataattaaggagaatgctaatgaaaaaatcattttttgaatatttaatgacacaacgcaatccgcaacctaataatgaagttgaagaatttgctaaccaagctttttttgatcaagtttttcctaaacaatcacgcgattttgatgagatcagtaaatatttagagctcaatgcgggctatctacaaagtatgtcaatttttgattcagcgtggcaaagatatttagaaagtgaacagttttaatgaaaaaaataatagaaaaacatccgtatttaactatcgtattttccatgattttaggagttttaattactattgtcagtggtttagtattttttgtagggattttaggtcatactgatggtgagaaaaatgattttaatcgtgtggcgagtgtttataatcaaattaatagtgattattataaaaaagtcgacacttctaaattagctacaggagcaattgatggaatgttgagcactttaaacgacccattttcggactatttaactgatagtgatgctactagtttgaatgatagtgtttcaggagccttcggtggtgttggtattcaagttgtaaagaagaatcaccaaattgaagttatgactaccattgatggtacaccggccaaaaaagcgggtctgaaagccggagatgtgattttagaagtagatggtaagaaattaactaatcaatccctttctaaagccaccaccttaatgcgaggaaaagttgggactaaagtaaaggttaaattgcagcgaggaaatgatacctttgataaggtgctaactcgttctaaaattccagttgagaccgtcacggctaagatgttgaagaataaagtaggttatataactatctcaacagtggctgaaaaaacttctagtgaacttaaacgggcgcttaaacgtttggataaacagggagctaaatcttatattattgatgtccgaaataatccgggtggtctgatgcaggaagctttaaagatgtcttcgatgtttttaaagaatggcaaaactattatgcaagttaaagctcggactggtaaagcagaagtatacaaggcgtctaaaaagtatgatggtggctataaagttactaaacctactacagttgttattaatggcgaaagcgctagtgcggctgaaatttttgctgcagctttacaccaatcggctaatgttccacttgtaggttccaaaagttatggaaaaggcaccgttcaaaatattacccaatatacagatagtgatgaattaaagctaacgattgcaaaatggctaacgccaaacggtacttggattcatggaaaagggttaaaaccagactatcaggctgattatcctgccatggcatacattacagaatttgatcagaaaaaaacgtactccgtgggagagagcaattcagatattaaaaatattcaaattgccttaaagggattaggttactatgatgataaaatttctaaagagtatactgagaaagtcaagcaggcagtggaagcttatcaagaaaagaatcagctagctgttactggaaaagttgatgcgaagacaatgcgttcaatcgaacagaatgtcattaaaactttagctaaaaatgatcctgctctagaaaaagcgcaaaaagttgtgaatgacgaaaaataaattgatttatggccctacagttgtagggcctttttgattggaatttttgaactaatttaaatatggtaacgttttattcaaactttctaacaaaaagtcagcatttttaacagtttttggttttaatttacggaagatagtagtaagttaaatatatctgttttaatcatagtatgataggagttttgagtaatggaaaaagaaacgcggaaaaattacggggcagcagggttgcttccgctactaatttttttgctactatatgttggatgtttagccgtttttacaattaaaggcgctaaagatccttcttcatacatgccacgccaagtggccattttaattgcattagtatttgcactaatattttttgaacctcgcagtaaattcagtaaaaaaatggacttatacctaaataatgctggaaatgcaggggtgatgaatttagctttaatcgttatgatggccggtggtttctcatccgccgtaaccctttcagggggacaatcctcaattgttaatttaggtgtttccttgattcctagtcaattcttagttccaggtatctttttaatttcagcaattatttcgctttgtattggtacctcaacgggaaccatcgttacgatggcacccgttacattttctctggtagccgctgcccatttgaatgcagggatggcaggagcagctgtaattacaggatcatattttggtgatgggttatctatgattggtggaactactatctcggcagctgctggagttggttcacctatgaaggataaattcttgtggcaaattaaaattgcggcaccagctgcaattttaactattatcgcctatactttgatgagtttaaataatggtggtgcccatcatgttgccgccggaagctataatattattacaattttgccttacctagctgttttagtgttagctgccgtcgggatggatgtggtcattgtactagcgttaggaacggttatggcaagcgcaattggaatttttcttggaaaagcgaatatttttgattgtgcgaaggcaattggaaacggaatggaaagcatgttctggttagctatttttgcaatgatggtcaatgggatggttgcgttaatgcgttattatggtggaattgactggttggtgcatgtctttactaaacgtattcatagtaaagctagttgtgaagctttaattggaatcttgagtttctgtgtaaccggagcaattgtaaataataacatttcagttctaattacttcacccattgctagagaactcggtgatgaatataaagttgatcgtaaagtgttagcagggattatttccatcttcgcggtaactgcctcaatggtaattccacaagactctgcaatgatgatgactcttcaattagccggtaagagtactaattatctggatttgattcgttatatgttctacccggtaatcttgatggcactaacatttgggattaattatttttcagccaaaaagagcactttaagtaaagctgaatagttaaaaagacgattagtatcgtctttttatttttaaataaaataaatccagaaagagttttatttctcttactattactataaaaattatagtattatgaatgcaaattgaagtttctcaaattttattttaggaggacacatgacaactttttattgttattctaagtgtagtacatgcaagaaagccgaaaaatggttacaagaacatgacgtatcctatggaaaaatcgatctagttgaacaaccaccgactaaagaacaaatgctaaatattttttccaagagtaatcagaaattacgctacttttttaatactagtggaatcgattatcgcaaaatgggacttaaagataaagtagaaatgatgacgaaagaacaggctgcaacattaatgtctaagaacggtaagttaattaaacgtccgttaatggtcgacgatactaaagtcacttgtggatttaatgtaggagtgtatgaagaaaattggatttaatataatgaaagacacacggttgtactaaaaataagagttggatttctgtagtttattcagaaattcaactcttattttatatggaatacgattaattaagacatcaaaattctatacaccaactagttcgactataaaatttttgatatggtagcaacacaattgaagacaaagattcatcattacttggtggaaattgggtctctaaagcaactccaccatattggccaatattctgtgcaaatccactattattaaaatggttaccagtataaacaacaattgatggggcagttgtttccacactcaatctacgctgatgatctaagctttctaatactgctgcaatattattatttcggttgagcaagaaaggatgattaagtcctaattgttctcttatttgtgaatctaaagaagtaattgctttaccaagtaatttgggttttcgaaaatcaaatggagtattagtgactgatttttgttcgccggttggaatactatttttgtccagtggtaaataatagtcagcatctaaagttagatattggtctagtatatctttaccgctatttagattaaaatagctatgatttgctggattacataaagtttttttatctgaaatagcttctatttcataaattaatgtattttcgtttgttaacgtgtaagttacataaatgcttaaattcccaggatagttattataattatccggatctaatagatgtaatttaaggatactacagttttcattttctttaatagtaaagccgaatacttgcgtatcgaatccttttgatccaccatgcgcatgattagggccatcatttagttcaaattgtattgtgttatcttcatcttgccagtgaccatgtgcaattctgccaataactctaccaacagtaccaccgagataattccgttctttatcataatattctgggcgttctaaacttaaaataatgttgtccttttcagatgttcgaccaggtacaaaaaaatgttcaagagttgcaccataatttaaaatatcaacttgaacaccatttttattaaacatagaaatacgatagtaatttttatcatctagtgtttggtatttattaactaaagtatgtttcatttcgaaattcctccaattaataaaagcactcacatgagtgcttttatattataaactaaattttttgaacgaatagtgtctgagcatcccttgatgattattagtcaattcagttattttatccatcattgtatgagctttatccacttgattcaatccgaggtatcctaatgcgattagataataacagtcgatgacattaagtgacttatgatcatctttgaatagcaaggcatcaggtaatgatacagcgaagtaatccatttcgaaattgtcgaaaatatgtttttcaccataactaattaatgcgtgaaatttaccatttgcttcttttgtctgacctaattgttcaaaggctaatccttgataaaaaatcgtatctgatggttgatcgttgtaatacatagcactagatggtttttccaatccttgagtagctaatctaagatgctcattagcttgttgagtatcgttaatttgtttgtaagcataacctaggtagaaatcgataacattattgtttgccgtaggaagttttccttcacccagtgagcgtggataaactaaagcacgattaagtttttcaattgcagtcgtataattttcgttagcaatatcttgttttgcaagttcaactagtgcatattcgtattgtgagctgactttaccttcgccaccttcccaagggtggaagatacgatccattaacttttgataagcttctttgtatctaccagtttcgttcaataaagtaactagttgaatgtagctatcgtcgcgttgctcgaccagatccaaatgtttttcaagaaaggctaggcgatccgttaaagaatggttcattttttgatacaaagagtccagttcaagaacaagccgtgcatttttaggatctaatttaaatgctttttctaaatattctaaggctttcttaggttggttagtcttgttgtagtagacgattgaaagattccggtaagacattgcgtaatcaggatcaagtttgactgatttttcccataaagcctgagctttttgatatatacgacgatcatagtataaattaccaagatagtagggtgctaagccatcttttggattgatattttgaatatattccaaaatgataacgtcgaacagacgatttgggaagatatagtcaggagatagactagctccaagttttgctgaagtaagagcttgttcttgcgaatccaatttagagtatatataagattcataataagattttaatggattatcatctttgtaaatgttcaaggccgataatgcatcagcatattgtccaatttcaaggtaaagttgaactaaatctaaaacatcatttaaacgagtatcaatgaaatgttttaacgtatctaagcaatctggattaatttttgaatattcgaacaataccgctgaagcactgttatcaatttccaaactatcttttaaaagtttttcagcttgatcggatttcatcaaaattaaaatatgagccttgattgctcgagctgttaaatcattatagttaaataatagtgcttgattaataaatttaagagcattgtctaaatcattttcgcgaatctttattttagccattgccacaaaactaactgattttgtatctgcagaccaagttgctttgtaaaaagcatcgtatgcttcagcgtattttccttgtttttcaagacttagtccaagatgataacttgggaaaccagatactgggttggtattatgattgttttgacgttctaaagcacgtctaaagtatttttcactttctacaaataacccttgacggtagagtaggagaccgtacgcatcattgattcgtttatcaaatttatcccgtttaagtccttctagatagtagttttcaggtctgaaactagcgtgacgatattgttcaagatgttgtcctgcattgaatagttcatcgttagttttgatatctttaggattaggaattgctttggcagcatctggaattgcttcgattttttcaggttcaggtgtatattgcaccaaaatattttcgtcttgatcaagtacttttaatgttaattcatgcaattcaaactgatcattttgaatggttgttgtaaaagtttctgtggggcttaatgtagttttttcgttaagtagaacttcgtcttctttttccaaaataacttgtgcatttgaaaatactgatgttgcatatgctgcaattgaaattgtatccccatctttttccaaattaactgcggcattgatcgtagcatttttaactgctcccacagctttataaggcataaagtattcagtactatgtttctcttcatgaggattgagccaagaaaagtcgggctgattatctgtgaaagtaccaaccatcaattcgatgtatggtccatcattatcggttaactgatgatcccaagattgtccaaaatcaccatgtccccaagtccattgctttttaccaggtgaagtatgatggtcagccacatgaagaagaccagcttctttctggtgatcgtaattacctaaaaagtcgtattttgatttggctgccatataagaagtaggtacaggtacatttttgtaacgagaaatgtcaacgccttctgagtaatcaactttataatattcaccagttgcgattggaaaatcagatactgcacgttttccgtgatcaaaaacagcattaacatctggtggaaagattgattgagtgttttcgtttacaggtactgcgggattagcccaccacaagaaagtctgtggtaaatcagttggatttgaaaaagtttcgtcaactttcaaatatgctttatcaggatacatagtgaaaccaactaaaatttttgtgccattcatttgatctatatcactcatccagattgttttagaaccgtctgaattaatcttagtgtaataattcactggagaaaaagtatctggccggtgatgttgtggccaattgaattcgattcctccagaaatccatggcccagccagaccaacaagtgctggcttaataacgtgattataatagacaaagtcgtaattattagttttatctaacattcgataaattcgtccacctaattcgggcaggaaagtaatctggatatacttattttctaagataacggctttgtatgtcttgtcatgtttttcatcaaagacacgttcggttaccggaaatggataagtcttaccactacttccttgatatactcgatcctccaaaaacattggatttttttctggcttagcgattccataggttggaatcgttaagtctgtttttttaaagttactggttcatctgcagaaatatcaatattcatagcaaagttctcccttcgattttacatcttaataatatagtagaaagcgttttcttaaaatgtacgaaatgtgctaaacgatggattttagacaactaacatttgcttggtattttgctatgtgataatatcgaaactagaaaatgaaaacgcttttttaaaaaggagcaatttatgaaaaaattgcatggatttgaaaatgaatatttatttgtgttaccatcaactattttgaataatttcaatttttctgaagtaataaaactgctgtatataactgatcttggattttaccccaaggcaagatatcattttgctcatcgtaatcatggcgccaaagaatggatactaattttttgtacccatggtaaaggtactgtaaaatctgcaactgaggaatggcaaattgagaatggttcaattgttttattacctccaaatgaggaacatacttattatgctaatgatgatgatccttgggatatattttgggtgcattttactgggaattctatagatgaatatatcccgcaagaggctttacagaaaaatggttttctaataattgataaaacaagcaccgaagatatgcagatgttaatgtcgcaattttggcaaatgatccaagctttatcagctggtttttcatatcaatccgttttttattcttctcaagttttaggtgctactttggcatatgtatctttgcaatcctttctaccgcatgatgcttatacaatggggaatgaatatataactaaagcagttaaatatatatatgaccactttgaagaaaaagttagcttatctacgttaactgaggtgttagatgtatcgaaaagttatcttagtcgaatttttagacaaacggttggcacaagtgtaaatcgttttattctcgacattaaaatgaagcaagcatgctactatttgaaagatactaatttagcggttcatcaaattgcaacgcgcctaggttatgatgatccgtattatttttcaagaatttttaagaaggtaatggggagctcgccacgtatttttcggaatcaagaaaaaaatatattgtagcccattatccatgtttatgatttagaaaatcccttctttgaaaatcatagtgtaatttcaattttagtttcaaatgataacgttttgaactcacatcggacttatctctacaacttggctaaattaatgggtaattaaagagaattggcggtgatacctgagtgaaaagttatttgccgttggtgaggaaaaatatgcgtattaaccattttgaaacatacatctaatgaaagcccagtagtaattaagaaatgaactattactcctaggcatgcaactttatgtttattattcatatcaattcagtagaatacttctcaccgctgaagaaactaatttatcagtgatattggaggtccaactaatttaactatgaaatgaatggttttattatacataaataagtattgattagttgatcgccgcaatttcatgtgtacaattttatagtgtataacgaacgtcataatacttggattacttcagaaattgaacatcatgaatgggcgtgaagaaatatttaaaatttcaaaagaagctgaattattagttaatagtgaactatttgaaaataaagcttcatattgcagggggaatcataggttacaatttcattttaaatcagtggcagatgatattcgttaatagttgtaaatgatgaagaatacagtttaatccataatgctttacatgatgattctggtaatgtgcttagcttttcccggtccaaaccaaaatcaaaaagtaacgtttaagttgttagattatatgataagtaatacagatgctaaataaatgattattctaagtacaataaaaaaggagaccaaattcgtaagtgaattggtttccttttttatttggaaaattattttttaacatgcttattaacttcttgggcgttaccaaatgaaacagttatgatgcgactgcgcattccccaaatgtagaaaataaatgccacaatgatgataactataaagtcaagaggataatggattaaatttctaccattaaaattatcactaccaatatacgacataactgaaaggaaaattaagtatacaatcaaccaaaggctactacgtagttgtttcatagtttctttccaatgtaatcgccattcgtaataaataaaaattggtaaacctagtaaaatgactaagataacttcaactgttgttggccacatggcccaataaatagctaaagaagctaaaacgaaagctaatggtgccataaatttaattgcttttaaacgaacaggtcgattgaaacgggaagccatttttctcaatgatacgaccgtgattggcccagtcaggtaagcaattaacgtcgaagtcgaaataacactggctaaagttccccatgatctaaaaatcgaaaccattaccatacttagaacagcgttgaaagccatagctactcgaggaatcccatatttagcattaattcttcctaaaattttaggaaaatgattattacttgacatagcggccaaggcccgtccagttgaagcagcaaatgaaacaccagttccaaagggtgaaatgaaagcatctaaataaagtaaaactgataaccaatgaatcccaagtaagatagctaaatccgcaaagggtgattcaaagttaattccatgccaaccagattgagtaattagtgcagttggtacggaagtgatgaaagtactttgtagaactaggtagagtacagcactgatcgagagtgaaagtcctacacctagcccaatgtttttcttagggttttcgacttcatttcccatattaattacggtttgaaaggcgttaaaggaaaaaataatcccagaagcagaagtagcagcgaaaatcgaagctgatccgtaaggcataaattccgatagtgattttccgtaattttcaggatgaaagccacttaaagttaaaaatataatagtaattaaaggtacagcaattttgaaaatggagattaaactcgtaaatcttgttaatagagttactgaccaataatttaataaggtgaagattaaaatgaaacaaaaaactactaatagaccactagtagtgatgttcccatttttgaaaaaactatgggtccaattcgcccatgcccatggccaagaactcatgtattggaccgcagctacagcttcgatggggatgagagtgattagagaaatccaatttgcccaagaggcaataaaaccaaccaatgatccgtgactgtattgagcaaatttactcattccgccagattctggaaacattgtccctaactcaatatagttataggcaattacaccaatcacaacaaatccaattatccaagaaaaaattgccgctggaccagctactgaagcggcctccattgatccaaaaagccaccccgaaccaattagagaaccaagcccaagcattaccagttgaaaaagatttagttttttaataaaaaatatcctccttaatttttgattaataatggtaaatactaacgtatttgtgtaaataaatcaaattggtataggacgttccatatttttatttaaaatttaatcgcttatatggatctaattaaatgggtgatagggtaaggtttaccaaaaccatcgactggatcttctgaatcaattttaaagttattttttagatagaaacgttttgcttgcacattttgcgagtttacatcgattcttttaatatcatatttgcgtactaaagtagacaatatttctctaccgtaaccttggccaataaattgggggtctaaaaataacatgacaagctcgtctttatcgataccactaaaaccaaccactttatgattttgatttttccagacgattaaatttactgaatccaaagcctgtggaatgatttccttgtaaaaaagtaaatctgattctttcaaaaagtggtgagtttttctaacggatgcttcccaaattttgagaattaaagggtaatcggatttagtagcagtatttgcgtttaaaataataacatctcctttcattgttagagctccatttctagtatgtttaaatggtatcatacggattcatttaaattaaatctaagtaaaaatgattttggatcatattacagtgtttatcgtatatatatttagtacaataacactaagcctatacatgaaatgaaggagtttttgatggaacaagaacgaattttaattttaattaaaccagatggtgttagtttagggcatattggggaagtaattacacgtttagaactgaaaggatattcaattgatgcgcttaaagttacccaagcgacggaagcacagttgcaacaacattatgaaaaattagttaataaaccattctttaaggaaatcgaaacatatatgttagaaggcaaaatcgtggcgatgattgccagtggaactcatgttattgatgtttttcatcggatggcaggtgctacagatccgtcggaagctgctttcggaaccattcgtggagacctgggacgggagtggccagacggtttactacgtaatgtggtgcacagttctgatagcattgaaaatgctgaaaaagaaatcaaaatttggtttccagaattaaactaagatgtgtttataaaaaagtaaattacagaaactagttaatcgatgactgattggctagtttttttatataagagctcattatttttcagtagcgagagtaataaataaaattagataattaaacttcctttactaagtctgttcatcagtttatatttattagtcattagaaaagggggtctaattgaacatggttttgagtaagacaattgcaaaaattagaaaagaaaaaaatttaacagtcaatgatctcatccgggataatatgtctaaatccagctataatcgttttgctgctggaaaagccgacattcacagccattacttcatcgagctactgaaacgtttacacgtaactttaactgagcttgaatatattgataggggatacgtacctaaagatataaatatttatctatccagaattaaaaaattttttaacaagcgtgatgctaatgctttaaaaggaattattaaaattttggaaagtgaatattcaaaaattcataacactgaatatcagcatttaatcggactttgtgagattttgattgctcgtttaaatcactataaactggatatgaaccagaatattttatatcgatacttgattaacacgtcttcttggactagatatgaaatcattttgttcaataattctctattttatattgaaccagaaactttgagcatcctattgagtaatgcattaaagcatgtccatgaattggatgatcttaacccacaagtagttgaagggtttagacttttaagcaacgccattatctctcttttataccagcaggaaccaactttggcgctatactatatttcaaaactagaagagtttcaagtgaaagaagagcacgtgtatgaaaggattttgttacttttttttaagggtatcagaaaaaaattagaaggttattctgaaatagagtataacaaagaatttaacaaattatattttattttagatgtactacaaatggaggagcaaaaaaggatttttaaaaatgccattgcaaaattataatgttaaaaatcaaaaataatcatttaaaacgaccgtgtagactaatttttaatgcctgcacggtcgttttttagaaaaataaaaagaaaagaacatattccatactaatccccccagttaaattatgcagataatctttagatataaaaaatatgtcccgtttaagggccataatatcctaaaaagaaatatagttacaatcagttaataccctaaattaaaatcagaagcacattatgaaattttaaacctttaatgaggggaggatagccatagacgcatttgtttagaataatgcgattagtaatgaataatgtttttaaatttaaaattaaattggagtgacttagattgactgcaaagtttggtaaaacgttcaataaaaagaaatattgtccacgtctcgaacctaagaggatcttaacattgatcaatttagctatgttagggcttggtatgagttatctacagcatgcagatgcagctcaggcttccgagattggaaaagtgaatacttataaaaatgctgattctttaaaaacaaatcagttattagagctaactaagaatggtaaaaccactaaggaagtgggtgttgatgtaaaaacagagactcatagtcaagcatcaaaatccaatgatactaataaaagagcagatagtaaccaagcttcaaggctacttaaaaaaaatcaaaatcggattgtcgatccaaaaactattaaggacggttggtcactaaaaaatacaaaagtgaagaacagagctctaataactcctaagaaaagtcatgaaaatcaaggtactattaaaaatacaaattttataaacagtgaaattaaagtgaaaccaaatgataaaacagatttacaggataatgtgtatgtaaacaaagataattttaaagattactttaatcagaatgggagtgccaaaggtaactacaatccaataaccggtaagcaaaagcttactacaggttcatggcaaagtggcaatatcacttttaaaggaggaatagaccttaggcacaattttagaattgatggtgcaattaatttaggaaaagaaacgaaagtaaggaatgtttttagagttttaaagggaatcgcagacggaattgggatcgttttttacaaaggaacccgtaaccaaattggtggaagcggtgggaatttgggtatctatggagtgactaatgcttttggatggaaagctgacacatggcataacgtgggtagatcgtttaagtttggtaacactaccaggcgcttacagggtgaagctgatgatgcttttcccgatccatatggtgcgatggtaactactaataaaaatggtcaagggaccattgataaagacagtgtacggcctttaccaaaaattatcgaagataataaataccacgctataaaaatgatatatacagctcgtacgaaagaatttaaggtgatcctttcgaccccaacgggggatgttatttttaagaaaaaatttgattatgatgctaaagatcccgtctattactttactatcgcttcatccacaggcgtattacctactaaacaattttttaaaattgactccatggaatatacgtcaattcaaaaagcatttattaagtatattgatgataatactggaactaacatgagagtccgtgtactaactggccagggtggtaaaacgatgaagtactctacaagagcagacatccaagattatttaaaacaaggttatcaattagttagtgataattttgtaacgggaactacttttgatactgacgatagaaccgatcaaatatacgaagttcattttaagcatggaatagagtctgattttgaaaaacggaatgtgaaagaaaccgttcattatcgctatgataatggtcaattagccagaccgatataccaaaatgtacttaattttgaacggaaggtagaaactgatcaagttacaaaacaaagaaattataagaattggcaggcggttgatggaactagttttaaaagagtagtttctccgtatataaaaggctataccgctataccaaaattgatcgatgaaattactaatattaacgaaaatcataaaaatatcgaaaaaatagtagtttacaaagctaacgacgaaaaagctcaagtgaaatatttcgatgatacaacagggcgaaagttaagtgagcaatttctacatggtgcttatggtagtcgagatgtttatcgaacggctaatacaattcagcattataaacaaatgggttatgagttggtgagtgatgactaccctaagaatggagcaaactatagtcaagataaattagttcgagtgtatgaaattcatttaaaacataaaatcattgagcaatcagaaaaaagtactgtaaaggaagtgattcattatctatatgacaatggtcatttagccaaaccagtatatgaaagtgtgcttaattttagtcggatggttggaattgatcaggttacagaaaaaaaatactatggaaattggcaagcaactgaaggtacaagttttaagaaggttgtttctcctaagatagaaggttatacggcgctgcctaaagtagttgtggccgtcaataatatcaatgttaatcacgcaaatatcgaaaaaatagtagtttacaaagctaacgacgaaaaagctcaagtgaaatatttcgatgatacgacagggcgaaaactaagtgagcaatttctacatggtgcttatggtagtcgagatgtttatcgaacggctaatacaattcagcattataaacaaatgggttatgagttggtgagtgatgactaccctaagaatggagcaaactatagtcaagataaattagttcgagtatatgaaattcatttaaaacataaaatcattaagcaactagaaaaaagtactgtaaaggaagtgattcattatctatatgataacggtcaacctgctggaccaatatatgaaaacgaacttgatttcaaacgaattatcaagtttgatcaagtaacaaagcagaaacgctatggaaattggcaagcaattgatggaacgtactttaaaaaagtagattctccgaaaattattggttatacgccaactcttgaggcaattgaaactatcaataacattgatggcagccataaagatatagaagaaacggtagtatacaaaattaacgacgaaaaagctcaagtaacatactatgatgatacaactcgaaaaaaattaagcgaaaaagaactaaatggagcttatcgcactcgagatagttatcgaacagtcgatgcgattaatcaatacaagtgggcaggctacgagttggttagtgatgattatccccaaaatggggtgttttacgaccaagataagctaataaaaatgtatgaagtacatctaaaacatggagaaaaaatggattttgaacaacgtgcggtaaaagaagtaatttattatcaatatgatgacggccaattagctgagccaacatataaaaataaacttagttttagacgaattgtaaaaattgatcaggtcacgggtcaaaaatattatggagtatggcaagcggttgacggtactaattttaggagtgtggtttcaccaatcatagagggatatacaccaatccctgagattgttagggcgattaataatattaatagttaccatcaagacgttgaaaaaacggtggtatatcaagccaacaaacaaaatgaggtggttggtggcaattctccaaagaagtttaaacaaattaaaataattctagtaagggtgattcacccaaatcgaggggtaaggattaacactgaaaagagtcacacaaaaaaaataagccttaaacctcatcatgacaggcagaaagttgagtctacacataaaaccaagtttaaactaaatacgctgataaaatcaggtgatgaaataaaaaagcaaaacccagtctgtcaaaagcgtgtaattaaaaaatatcaaaaacttcctcaaactggagagaagaaatcaaacaaatttgtatattttttactagtaccgctgttaattctatctacgataatcacgattttaaaaaggaagtaaacctaagaaatagaaacttatggtgtagtgactattgaacattaaatatagaaatttttagtgacacataaaaactcctatttattaataaataggagttttgttttccaatatcaaaacttaatattgatcaaaaataatttagtctttaattgggaaaaggtaatttaaatatatttagctactgaactaagcattttagcacgagccttaggagaaacgtcttcggcattaaaattatgccatttaaaatttttaacaccagactttctaaaaacgccacgttttaacatgcgaccaacaggattcccatagagaactttgtatatccaggttggagcaccagataccgtaagaactctaactttggtgttcgatgaaaatagtcgtcgcgtaataccacgatgttcttggatttgtcctttggcaaataccttatcaataaaacccttggtcattgcaggcatcatttcccaccaaattggaaataacataatgatttcatctgaattttggagcctttcgaagtagttttgactttgagtatcaacgaaagggtgagttcgccaattaagtaaatcagttttagtcattaaaggattaaattgatcttggtgtaggtcaattaaatctacttgagcgctttgtttttctaacgcctgtatcacagcaactagtagagcagaagtaaaggaacggttatgtggttcattgtaaccagcttcttttccatatgggtgatcaaaaacaattgttatttttttcataatatgctcttttcttgtgtttttatattctttggaatatatttaatatagcaccaaaatttataaagtcaatatatatgtcgaggaatataaatgaatgaagaactagctaaggaactaaaaaattaccgcgaacattctaatgaaaggtccattaaagaattaattggtagccacaatgatatagagaacctgaataaactttccattatagaactagatgtgattgcatggattgccgattataatttaaaaattaatgatttattgcggtatataaatatgactcaaggggctatatctaaactggtcaatcgacttgttgaatatggatttgttgaaaaatatcatatgaaaggaaatcaaaaggatacgtatttgcgacttaccaatctaggtcggaaagtagaggctattcatcaccaatttcatcaagaactagaacaacgcttagaacaagcactagatcaattcactgaacaagatattagaatcaccgttagtgtattgaaaaaaatcaacgcagcccgaaaccaattggattaaaaaagcttattatgttgtttagtctcagtttttttagagataattaacaaacgtaataagtttttttgtaagtagcgaaattcttaatctttagaaagattgctgatcaaaatactattatgcctgagagaaactaaaacagctagatcagcaaaatcagtatcacggaaagttaacatttaatctggtattaaaaaagaagaaaataatattttaggaaaaaatgaatacttagaggtttccaatcgaaggatggatcatattttaaaaataaaagtacgttatgggaatgagaaaattcagatgttaaagtttttgccagtcagaaacgaatggtttaggaagtaagagttttcataaataactaaaccttttagagctagagcatgactttttattgtgaaaatacaaaaatagataagctagttaactagcttatctattttttttagtatcgattattttttcgaaaatagatccaatcaatgcattatctacggaacgtttcattgcgatcacaatattttgattaccaaaattatcggttaaatctttaattttaatacggtattgtttttccaattggccgtcattcattgcagaatataggaaggctaatccatttcccaatgctgtcattgaaagtccctgacttaaatttttaacataataatttgcttttaaattgtagccatttttgattccttgacttaacacattgtcgacaataattggtgatttatctcgatctaataaaataaaagtttcattttttaaatcggaaaacgaaagctgtggtttcgcggctaaaggatgattaattggtaatgcaatctgaagatgattttctaaaaaatccgtgcttttaaacaatacgttgtcagtggtatagggtcttaaagagtaaatcaagtcatatttaccagaagataaacctttggataaattagttggggtgtctggaaagagcgagaactgaatattattctcatgactaattcggtccaggactgcatacattttttctaaacgaaaattttctaaatagcccacattaaggtagtgagttggattgctagctgtttggtgttgatcaaagaaatgttttaatgcatctacgtcttggattacttttgtcgtagcttttaaaaaagtaatcccattttcggtgagttttagagaatgactttgacgaacaaatagttgagtatttaattcagcttccaaatttttcatgtgacggcttaaagtaggttgagaaataaaaagtttatcagcagccttagttaggcttccttctgttgctacttgaacgaagtattctaatgttgttaaattcattgtgactccaatcaaaaaaggatttatagtcattaatactacaaatcctttagttaagcaactaaattcttttctatttttttaagataggtaattgtaaataggaatcatattcgccaccagtatgaagggtatggataccttgattgtcaggggtagcaccaggagtccctggcataacagaacctaattcattcttggaactgattacaaaacgtaacgattcgccaggagcaaaagtcatccccattgggcttaaaacaatatctaattggacaacttcttttggtgccaacttttcaacgcgatcgaatgaatatgcaggaatctcatccgtgctcatcttatcatctaaatgacgcatcgaagctcgtagacggccccagactcctttatagcggagggctgaggcaccttcttgagtaaagtcttggagggctgcaccgtgattaggtacaacgaactcacttaacacattactgtatttgtctaatttttgtaccatgataaagatatccatatcatcgtaaccgtcgacttccatgaatagctttgccttaggataaccgaccatcgtgaccggcgcatcgaaagtggttaaaaatgagacacgtccaggattgtcgttagctacatactgcactgtggcagcctgtgacaaaggcttttcttgcaaagtccgagttaagggattgagataaaatggttggttattcacaccagctggtggaaagctagttgctggaatatctgtctcatttttgccttgaaaaccaatggtagtgtagcgaacgggagctgtattttcccatccattatctttgccaagtaaatagtggtcaaagaaacgacgaagttcttccgtattatttttatcgtaataataaggccattcttgacgatcatgaattctgagccatttatctttagatcctaaggtgcgccaagctcggaatgttcccatggtatgcaatgtgttggaataactgccaatcacaaaagcgggaacttcaattttgctggtatctgcaattttgtcttgccaaacgggagccgtaactaacggatcagcatccatttctttagctaaatcctcacgtttggcatcatttgcactgacatgatttacggctaagcgttcaataaagtttttgtcaggaattcctccgataaaggccaagtcacgatatgcatctgataaaccttcggtaggattaattgcagttaaatgtggtggtctttcagcagcaataaaccattgtgaccaagctaaataggaagtaccagttagggccgtcttaccgttggaccaatcttgttgggcaatccattcaattaaatcataaccatcctgagcttcttgtgaaccaagcatcgttgtatttccttcgctatgagcgattccacgcatatctgggttagccactgcatatccatgacgagtccagtaggctggatcaggtgcctcaaatttagtcaatccagaattccattgattacccattccaagcatgttaaaaagatttttataccttggtgcagttccagcgcttttaccgtaagggctccaagcaattaaggtaggaactttgtcatttgtaattggtaaataaatatcggtatagatggttactccatctcgtaatttaacagggatatcttttaacattttgatatcagtatcaagtggtttaaatccttcggcgattttttcgcctttctttaggattaattctttggtttcaaatgggctaaggacaccatgttctacaccatcatcaatatatgcaaaagcatcactaaattgcatttcttttgtaacatcaacagtcataactttacctccaaatatttttagtaagtttgatttaacaaactaaagtatatgaggggggagaacttctgtacactatcatatttgcaagtttagaagggactaggttgtgatatttgaaaaatgaatatcaagtttgattaatatgttagtacttttaatagctttaagaaatcaaatttcttaaaaatagaataataaaatatttatttgaaatattatttcttttattataaaatataactgtaaatgaaagcgcatacaaggaggagcagcatgattaatttaagtgatttaacaacggaaactcgtaatgaggaaaccatgaatttagacgagctatctacagcagaaatattaaaaataatgaattctgaagatcaaaaggtagctcaaagagttggtaaggtgttaccagatattacacaagctgtcgaacagattatccttagctttaacaaaaaagggcgtttattctacattggtgctgggacaagtggtcgactaggtgttctagatgctgcagagtgtgtaccaacttttggaataaatcctaagatggttcaaggtttgattgcaggtggaatgaaagctatgacaattgctgtagaaggagctgaagattcactagagctaggtgctagggatttgcaatctcaaaacttaactaataaagatattgtcgttggaattactgcaagtggacgaacaccatatgtcattggtggattagattatgccaaaaaggttggtgcagcaacgattagtctagcttgtaatgatcacgctaaaattagtaaacatgctgatattaacattgaaatagcagtaggccctgagattttaaccggttcaacgcgtttaaaatcagggacagcccaaaaacttgtgttaaacatgctatctacagcctcaatggttgggattggaaaagtttataagaacttgatggtagatgtgaaacccaccaatgctaaattagtggaacgttcaaaacatattattatggaagcaacggatgtcagttatacagtagcgaatgatatgtttgaaaaggcgggtaaagatgtgaagttggctattgttatgatcttaactaatgttgacttaaatgaagcaaaaaagaggctacaggtagcaaaaggttttgttagaaagacaatataaagtgggggtgagaacttatgtcagaaacatctgaagaaaaaattaaaagaattgcacgtgaaatttacggcgcagttggtggtatcgaaaatgttgaaaaattaattcattgtatgactcgtgtccgaatgaccattagaaatgatgacaaagtagatatcaaaaaactgaaaaatattaatggggtattaggagtcgttgaagaagacaccctccaagtaattgtcgggccaggaactgtaaataaagtggctgatgaaatggtgaaagaagctggagttaaattgggtgagtcatttcctaatatagaaatagatacaaccggtatgactgataaagaaatcgttgaggctaaggctgctaaagtaaaggctgcacaaaaagctaagcaaaaacaaactcccattaagcgaattttaaaatccatttcgaatattttcataccgttaattccagcgtttgtcggagctggattaattggtggtgtagctgcggtaatgtctaatttaattgttgctggagatataagtaaaagctatactgattttgtcgcaattttgaaattcattcaaaatggtgtattttcatatttagcaatttatgtcggaattaacgcggcaactgaatttggtgcaacagctggattaggcggtgtcataggtgcggtaacgttattacctggaatggatattaatgcacctttgcataatatttttaatggtcaaccaatgagcgctggtcaaggaggaattatcggtgtaatatttgccgtttggttactttctttaattgaaaaaaagttacataaatgggttccggatgcaattgacattatagtaactccagcactttctttacttataattggagtatttacaatttttattattatgcctatagctggtgttatttcaagttcgttagttggagctattaattggattctaaatgtcggcggagcattttctggattcattttaggagcactattcttgccgatggttatgtttgggcttcatcaaatcttaacgccgattcatattgaaatgattaataaaactggttcgaccccattattaccaattttagctatggcaggtgctggacaagttggagctgcgattgcactttggctcagatgtcgtaaaaataaacagcttacaaatatgattaaaggtgctcttccagttggtattttaggtatcggagaaccattaatatatggtgttactttaccattaggtcgtccgtttatcacagcttgtattggtggcggaattgggggagctgtcgttggtggattaggccatgttggtgccattgccataggcccatcaggattagcgttagttcctttgattacgaatggacatatgatgtcttatgtgctggggttattagcaggatacgttggtggatttgtagcaacatatttctttggaattccaaaggatgcaattcttggagaagcaacaactgttgagacagatgctttaccccaaaatggaaataagaaggtaattgatccaaatgttgcaatgactacgataacggctcctgttattggtaagaaagttgcaatcgatacagtaagtgatccaatgatggcccaggaagtaatgggaaaaacagtagttataatacctgatattaattctaaaatctatgccccggtagatgggaaagttactatgatagcagacacaaaacatgcaatcggttttatggataaaattggtgaagaagtcctagttcatatgggggtcgatactgttaagttaaatggcaagtattttaatttaaatattcaagtgggcgatactgttaaacatggagatgtattgggtacagttgattggcaaaaaattattgacgctgattttgatccagttacaatgacgattgttactaacacatccgattttaagattgacgaaattgaatcaaatatacagactaaagataataccgtattaatggatagtaggataaaataactatattaactaagtattcaaatttagaagatcggatattttccggtctttttggatatattactataatttataattaggagctaatgttaaaactgacaaatatgtgggagttcaaagttttatgaaaaatattttatttacattgagtaacgattttgaaaaattttcaagatctgagcagaaagtagcccgatttatgatcgattatccgcgagaggtgattcagatgaacgccgaagaaatttctgatcgaactcaagtaagtccggcgactgtagttaggttagcaaaaaaaatttgtaagagtggtttaccaggtttaaagatccaagttgcgtcagaaataaaagtagatgattctttgtatactgaagttaatccatcggatgacttggatgttatgaaacataagctggagtttcgaataagtcatgcaatcggacaaactaaccaaatattacttaaagatgatgtaaaaaaagcaaccgatgttgttgagcaagctgatgatatctacgtatttgggatgggtgcatctaatttagtggcagaggattttcaacaaaagtttattcgaattggaaaatctgttatccaaacattagatacacatctaatggcggtcggattagccagacctaattcagtattaattgttgtttcagattcgggtgagactaaggaaagttgccacataaccagagtagctagttcgctaaatataccaataatcgccattacgcatgcacgtaacagtactatcgcaaaaaatagtactgttacgctaatttacgatgacggtggtgaaagtggagtgttacggactgctgcaaccacgtcattgttagctcaattgtacgtggttgatttactctactatgcatatttaaccgaagattttagtaataataagactcgtttagttcagtcaaagacgattattgctgaaaattttggtaagtaaggtttagagaactaatatgtagctgaaagatacttcttaaaaaggccaattcgtgagaattggccttttattatagatatatttatttattagaaccccccggatgtttgatttataaccgaactcctttagactctaaattttccagacattcaattaaatactgttgatcatgttctggatagattggggaagttagtgggtaagcacataatgctaaataaggcggacaatggaaaccacggaaagttggttcaaaccatttagggttaggatgataacctcgtgactgcatctcagctaatactaatcgatgaaattgataaagtttgtaaggagaatgagtaaaaacataatcaacggttgcgtgttttttaccccaaccgttacctcgtaaggctgcaatttctcgatgctgtcctaaaagctgggcacgtggtagtttagaaattaatttttcatgccataatcgcatacagacgaccccccatttttaatttaagcatagcgtaatttaaagataattaacactaacttgactgatgaattctcactagcatgcctctgagttaaatatgtattttttagaacggatatgatataaatagctacaaaatagtttttttggaaatatttaaagaaatctacttaaaaactttttagctgacaaagtttagcttatttgtagtaaatttaaatcttatgtgaggtataaaatgaaaacgtttttaacagccacatctttaaaaaaagtggttttattagattatctactagaaagcggggcatggtgttctactaaagaattagcaaaagtaatcggtgtaacggataaatcaattttaaattatttggaagaatttaagcagttattcaagtcgaccgatcagaaaatcagattattcaacgaccataataaaaattttcgaattataaaagaagaagattttcctatctatacaatttatttgaaattctatcaagcctcttacaattacaaattaattgattttatgtaccataaccctcaccaacgattggctgactatgcagatagtcagtttacgagtatatcaacagtttttagatacgctaaattactaaaatcgtatttcaaacgttataaaattcaatttttaccgtataagttggaattaaaaggagatgaaatcaatattcgtagtttttattattacttttattggaactccacacgggaaatgcggaataattggccatttaatactgaaacattctagccactatgaacgccgttatatcaatatttgtttatcgctttggggacatttggggacactgacaatatttctatcgttttatcttgttcacgggtcttctcttccttgagcatatgagcgtaaactttttgagtaatgcttgtatttgcatgaccaagtctagccgaaacgtagttaattgaaacacctttataaagcaaataagaggcgtgtgagtgtctaagcccatgaatagttattggttgtaaatctaacttgcttattagtgaatcgaggcgatttcttactgtttggcgtctgcaattaaaaataaattctgtactattgtttttttcattgctgattatattagctagctcattagttatttttatatcacgcacagaatttttatttttaggcttgccaacgatattcccagaacgtgatttattaacatgaatgttgttaaagggaatagagacgtccttgtactgcaaggctagcacttctccaattcgcattcctgtttctaatgctacaaggatcgcaaggctagctttatctaatttagagtgatataaataatcctgtaatttttcaaattctgtaactgataaagcgttagtttttttgctacgttctataccatgtggtttaagccgtgtgaagatatcatctaaaatatatttgtcgtaaagagcatcttttaggcaagctttaattctagacacaatcaaagtcatagtgcctttagaaagtgttttaccgatggtatcaagtctagattgtagaagggaatacgttaagttttcaagggtaatcccatcaaacgattcttttatgtgtcttaatgttgaaatataagtattataagttgacggtcttatatcgtttttcttgtaagtctccatccacattttgaagtaatcggcaaatgtcatactagaagctattatgcttctgttttgaagcttatcagcttccatcataattgcccaatccttagcttttttctttgtatcaaatgttttagataccttacgtcgtacgccactctgcatgacggatacgacaactctagttcttttacctcttttttcaaatgatgccataatggcgaacctccgttctcttttcggaagtagccctcaatgctaaaatagacaatataaaagaggactacttaatgtagttttttagggttaggtcacatcccaaactttggtcggtgggggatgtggcttttttattttgtggttattacatatattgtagtaaccactattcccacatacagagtcggactgtatctagtcaccggagtggaaaggagatatcatctaagctgagggctatcaagtatgattaaaaataagccaatgcagataaagataatcccccaaaacatctgtgtaaacatactacgatcaccaaaaaagaaacgtaagacatttaaagttcgaccaagaggtattattaatgctccaataaaaaatataattattccaatgatagtcataatactcgtttccataaactattcgctcctttgtaaataaagtattaatgtaacgcggtatagaatgtaaaaaatcctaagaaaataccagggatgttagctgcaatgatcgaccaatcacgttctaacatcttacttggcggttaggggatgtggcttttttgttacaacgcgagcggcaggagtagaacctgcatagtagttgttaagagcgggagactctattttggagtggacatgttctaccgttgaactacgctcgcatattgcccactaggctggtagtgggcgagggtgctacttactttgatgttgaacccgatagttgcgaatagcaagagcaaataagacaattgccagcgcaaaacatccaatcataaacacaatccaaccgtatgcttcaaaccaaacaatcacgttcactaatattccaaatccaatgcaccaccatagccatttagtgaaaaatttatatactaaccatccaatgataatagtaaatccaattaatgccatgattatttatcctcctgtttgttttccaacgctttaagcttagcctgaataatttcattttgtgtttccaattttttgatttcagcgtataacttgtcgaagttagaagtatcttctttggaaaagtaactagtgatggtactagttaatataccaataaagccaacgccaattagcattaataaaacagcggcaaattttcctactaatgtgtgtggtgaaatatcaccgtaaccgacagttgtagatgtaacgattgcccaccacattgcatctccccaagaaacgttttctgctatcgaatatagagtagccgagatgaataagattgctaggcatacccatagcaaatatataaaaccatttattttagagaatttttttaacttagattgtgccttaccaataaatccaataagtctaacaaacttaaataatttgagtaaccgtagaactcggaacattcttgaaaacctgaataaagtaaacattgaattaaatggtattatcgctagcaaatcaaaaatattgtgtttgaaaaagtattttttgtctgtagcttcgataaatctactcacataatctaatgtgaaaataattagtattccatcatcgactatattccatggagtgctattcaagtcgataactccagaaaaatcaaatatggtaattgctacagaaaatagagccaatattcctataatcagttcgtaagtcttatgtgcatgtttcaaaacttggttaccccttaaaaatcttaatgccaccgctgaacgtagatcttgctagttcaccaccattttgagagtagaaataaattattccggcatcatagtcttcaccactagcaagagtattagcatgatcgcaaatttcttgagctaaagctgtaaaatctgctacgctcatattttcgactgaatttggaagcacaactttaacaactccatcttcaatacttgaagttcccattttcttgttagaaagataaacattgaaatccctgataaacagttttccgttctcatcgtcctcactagactctttatcttcacttgatgaaaacttgctatcttctttagattgacttattgattcttttcgtgacgagctaatagattcttgttttgcctcattaacacgcttagaatgaccagacaaatacagtccgaaaaatattaccaatacactcacaacaattgtcagtattttttggctaatggaattgctggttccgtcttcattttttaaaaacataccgatacataccagtacagtaaagacaataattatccatcccaaaatcgttataaacattcaataattcctccaaatatgtacagcttttataccgtcaatcagtatttggacgtaagactaattaaatacctattttttcctcaaatacattatctaccacatatccagctctggatggaattccaaaagtgtccataaattcagttgaattataaaaagttagaccattcaaatcacaatattctaaaagtatttttgtcgcacgtttgttagctttatattcttctttgctatatacagaattggcagaaaaattattagatcccttatctccattcaatatgtggctaatttcgtgtgcaaattgaaatggaatttcttcaggattcttccaattattattcataaaaacgactcttaatgcggtgtttgattttggtgcttgatctggttcacgaatgctatcaaattggtatccgatttgatttgcaaaagcataatctcttaaaaatgtcattaaatcgtccatacaaaaacctacttcttatttttattatctaaataacctttaatgattccacgcattacttcacgctcctcatcactaatcggttgtccttgatagctccgcattgaatttaaagcctcttcaacctccatgtcacgagtaccattcacaggttcttctttttcagtttttcctaataggtaatctacagtaacgtgcaactctttagcaactgcttttagtttggctgaatctggtgttctacgtttccatccatagatagttgtttctccaagtcctgcatcttgagcaagtgtacgcagaccaataccacgtttttttgccagttcatttattcgatcaaacgttgtcatcatagtattctcctaaaatgcttaaaaaaacttgcattaaattgaatacattctattgactatttgtattcaataatatacaattggttttgttaagaaatattgttattaaaaagagcaaattaaaaacaccaattaatcagctggcaggcatgacaatagtggcttttattgcttatttaattatgcttttattgtacgacattgaatacaaaatggcaaattattcttaacaaaattcaatagtcaatacaaaaaggagggatttacttgtttatccatatggaaacaaataacaaagctgaagcaattaaggcttggctatcaaataatcgacgcttggaaaaccaaggtagtttagctaagaaatttggtaagtcacgaacctttgtaagtttatcacttaataaacaatcagtaacacgtgcttctgaaaacttaattaatgagatatacgaatacttgcacgaaaaatatggaatataaaatttgattttatattcttttagtcgaatcgactagtttcaccctatgttatctatgtaggacaagaaagaaggaaaacaatatgaatgaattacaaaatttcagcttcgaaggaaacaaagtacgaactgtactaattaatgacgaaccatattttgttggcaaagacattgctgatgttcttggatattcaaattcacggaaagcactaattgatcacgtggatgaagaggataagaataccgtaacaattcgtgacggtaataaaggaaaccctaatcaagtagtgattaacgaatcagggatgtacagcttagtactttcaagtaaattaccaaatgctaagaagtttaaacgctgggtaacaaacgaagttctgccatcaatccgaaagcatggtgcttatatgacggatgaaaagattgaagaggctttgctgaatcctgacacgattattaatctagcaactcaactaaagaacgaacgtgaaggcagactaattgctgaacaacaggttaaggaatttcagcctaaagtttcatattacgacaaagttttatctaacgacgcattaatgactatcagtctaattgctaaggattatggaatgagtggagctggcatgaataaattgcttcatgaattaggagttcaataccgacaaggtggcacatggttactatatgcaaaatatcaaagaacaggttggacacactcagaaacaaagatggtttctcgtaaagatggtacagaaaaagcagtacttaatactaaatggacgcaaaagggacgtttagggttgtatgagttgttaaaagacaatggatatctaccactaattgaaatggaagacgagtcagcggtgtagttaagtcgataacttgatgaataaataacagaaaaggagaactaaatatgaaaaagttaattaatgttttatgggcaatagaaaaagaccttcgtattatcgctagtaatacggaagtcttaaaaagcaataaagaattcattggattcgatgaaagtacacataaaccaagatttaaatagtcttagaatgttctagaaaatatttaaaagccgaatcataaacttcaactacactaacaaaatcttcttcatttttcgattcattgtttagaattgcgtcaatttctctaacagccgaatcttgatttaaagaatttagataagtttgcgtggtcaatatagcaaactcatgagctcgttgttccttattcatcaatatcaccaccttttattgaactaactaaattatacacatgaaaggaggagaacaatatgaatatttaagaagcagtaaagcaagcacttaaaacgagcaaacaattttaccgtagagtgaaggggaacaattaacatttgaagtttctaaatcaaatcgatgcatagatatatagaaatggagaaaaaatttctggttggtggaatctaagagataacgatttgatggcaaatgactggaaaataaaagagtagtttctaatggaaccacccttgatattacttagtaggaacttttgttgagattaaaatatcagtcaacaaatcactaccaaattgtagttcgataaatcctgaaccttgaagcgaaagtagagattgtgcaaaatccatatcgcttagagtagaagctttgcgaacttttgaagggtctatattggtcggacgactatcgtcagcaagctcaattatcgtatttaacaatttttcatttgaattcacttgtatcaccaccctttaactaaattatatgcatgaaagaagagaacaaaagtgaaaatacaaagctggttagaagaccatgaacgtggattaatagcacttagtggatttttattaggtgcactaggtggaatatgtggggcaattctcgttatctggttacttaattagtaaatcattaattaaccaccttttattgaactaactaaattatacacaagaaatagggaaaataatatgaacaaattagtaattatgaaagaccaacaagcagtaacgactagcttacaagtagcagacagactaacaacgttaggagcatagaaatggcagtaaacaaaaacagattgtctgatgacaagtatccaatgctaatggacaaaaaaacagtagcagagtatttaggagtttctaaaagttcagttgatgtttttcttttaaacaataacttgagcgcagcaacttttgaacctagcaagcttaagcgaaacttttttatcaaaacgaaagttaataaatggttggaggaattgtaatggtagtaacagtaagtctgggacagttagcgttttatctaatttcagtagtagtggctggattaattggtcactcaattaaaggtggtgagaagtaatgaagatgttaaagattacggaagatttgtatttgaactcgtatttcattaaatacattgaagctgatggtgaagaatcaacactcgtaacagtaataagtgggggaacatttagtttagatttaccaatcaaaaaagtgctcgacgctattcgcggtagcgaggagcacttagtaaatgatgctagtatgaatattcttaaagcagagagtattaattctggtcatttgaatcaacaaaaatacccatctcggtaaatacattaaaaagggtgattaatgtttgcttcgtagtgatcttgttaatgtattgaagagaattagcaagggcattgatctgttcttggttcaattgggtatcagatgaattttggatattggaagcaacatatttcatttctgctttaatagattcttcagtccaaacagcatccatatgtttatcaattagtttcattatctgttcattggaaagttgcataataatttcacctcctttcatatcgattatacaagaaagaaggtgttcagaattaagaatttaaaataaaaagcccgctacggcaatagcggacttcgaaaacaaataacatcaaaggaagtataacacaaatgaatcaacaacagttcgaacaatatgaacgtgaatacgaacaagaacgagagcgtaaggaaattgaagccttattcgggaaggacgaacacaaatgattagtaatcttagcgaacctttacggacgatgtaggacacttaacctaaggagaaaataatatgctacaacaaacaatcgacgttacaacaacgccagagcttaataaagctctatatgaaactcaaaaagttcttactcaaccatcgaaaaataaagatgcacactatggcaaatatgctgatttaagtgcgattgataaagcaatccgtaaagcgatcattatggcagattcaggcattagcttttcacaaggtgtgattgatgatgctaatgcgaacggcaaggtttcacacaagatttatactgtcattcgtcatgttagtggtgaagaaaagatcatctacggtgattcattcccagatgattcaaacatgcaaaagcagggtgcaaatgaaacctatgctaagcggacaagtttgtgtctagcattcggtattgttgctgatgatgatgacgatgggcaaggtgtttcattacttgaacagtatcagaaaaaagaagaggaaaacaaacttaaagttattgcttaccttaaggacaacattaagaaagttaataaggacgtttctgaacgagtatttgccgtcttaggtaagaaagataagacgttagatcatttgagttatcgccaagccttaattttaagtggggcattgatgtatgaactttcaagagaaaacaccgaagaataggaaggtatattaaaaatgatacaaattacaatttctggaaacgttggaaaagatgcagaactacgaaatattaacaatggtatgcaagtatctaattttaatgtagcagtacgacaaaatcgacctgatagtaatggggaatatggtacagattggtttaggtgtgccgtatggggaaagcgagcacagacagttaataattactttaaaaaaggtagtcatgtaactgttacgggagtcttaaatatcagtcaatacagcggtaaaacacaacttagtattgacgtatcagattttgacttaccagataaccacaatacaaacaatgctaattcaacaaagagaaatagcaataattcatttaacaatggcggacaatcaatcgatattggtgacgatagtttgcctttctaaggtgatgtaaatgcagagagcaagagcggaacaacgaggcagagatttggtaattcatctcgatagaccactgaatcaagaccatttggaaactgttagcggtgggcaaggcgagttctacgttgatttcgaagtggcagacccaaggagagcaagagtacagcaacgaagattattcttcgcattgctccatgacattgaaacttacttcgtagtgccgagtgaatttttaaaatcaatgttctatacccagtacgagttttataccgcaggtaagtctatcagcttatcagacaccacagaatcgtctgttagcgatgctaatcagttgctagacctagttatcgattttatgttcgaatggcgtgttccatttaagaaagggtatgaactattaccaaaagaagaggactactacctttatcaatgctgtagacaccgagtttgtacgatttgttctaagcatgctgacatccatcatattgatgtagtaggacggacaaatagaaacaaagtcgaccatacaaagcgtcatgtaatggcattatgtagagttcatcataatgaaattgaatcaattggagcgactaaatttgcacagaaatatcacgtaccagttactggtattaagttaaaaattgaagatttacaaaagttaggcataagagggaactatggaggtgattaattggcacagcgtagaatgctaagcaagcagattacagaaacagatatttttatggacatgccattgtcagcacaagcattgtacttacatttaattatgaacgctgatgatgacggattcattggaaatgcgagaactattttaagaatggtcggagcaagcaacgatgatctaaaactcttaattgccaagcagttcatactttcttttgatgatggaattaccgtggttaaagattggcgaatccataattatattcaaaaagaccgatatcacagaactatgtacaaagaacatctcgaagaattagaagtcaatgataacggcgcttatatcaaaggaaagccaatgtatacagattgtatccaagatgtatccaaaatggatacccaggttaggttaggtaaggttaggttaggtaaggatagtaatatatatagttcatctaacgatgaaccgcatatcgacttgaaaacatttaaagagattattagctacctgaacgaaaaagcagggactaagtaccgagctagtggatctaaaacacaacgattaattaaagcaagatttaatgatggctttaatgatgaagatttcaagaaagtaatcaatattaaagtagctgaatggagtggtacagatatggctaaatatttgagaccagaaactctgtttggtactaaatttgaaagctacttaaaccaagaagttaagaaaagcaaaacaaataaaggcggtgattcgtatggaggacttgagttttaatcttttaaatcaagctaattcaactgatgaatattgtaaaatccaccctgatcagaaactagtaagagtaggtaatgagcataatgccttttgtacattatgtgttaaagaacaacgggaaaagcatttaaacgacttagtgctcaaaggggtacttagcaactaccatcggggatttagggacgttttgagaaaagattcaatcgtagatgatgaagacctatggcaagcaagttttgaaaactacgaggttgaaactggcagtgaagcggaagttaatttaaaaaaagctaagcagattgcatataaatatatggatcgtaattatcaagctaataccatcattactggtaaccctggagttggtaagtcacacttagcaatttcaatgttaaaaggcgttaatgatcatattaaacctaacgcttcatgcttgtttgtttcagtcaatgaactgttgcgattgattaaagattcatttaatcatcctgatggttattacactgaatctcgtatggtggacttgctcggtaaggttagcttgcttgtgttggacgatttgggcagtgaggcttcgtttaagcgtgataacagagaagcaagtgaatatgtacagcaagtattgtttggcgtcttaaacaaacgcaatcggacgattattactactaatctcaatagtgacgaattatctaagatttataatccaaaattgttaagtcgaatgtataaaggcgttatgaaaaacgacggaattattaaatttaaagaaactcaagataaaaggatggcgatattttaacgtgtgaaatatgtgaaggaactggaagagtttatgttgaaagtccaattggagtacaaattaatccgtgccctaaatgtaataaggcttaccgtaagaggaaaggatacgagcattgattaaattaacaattccaagcgaaccaatagcacaagggcgtccaagatttgttagtcgaggaaagtttgtaagcacgtatgatccgcctaaatcaaaagcgtacaaggaactagtagcacaatatgttagagaacagtatcacggtaagcttttagagggtcagttgtatattgtgttaaatgtatttagatcagtacaaaagagcatatcaaaagcagaacgtgctaggaggctatcaggagctcatagaccgactgtaaaacccgacatagacaattactttaaagcagtgacagatgcttgtacggggattatatggagagatgacgccttaatagtaaatgctaagatgggcaaattctattcagaagaaccacgagtagaaatttatgtggaggagctatgaagctatgaattttaaaaatttaactagtgaagaacgcattgtggctaattttattaacgaagcttttgaagaacacaatcaaagcatgataagcactatcgtttggattaataaccatgttaatcatttagctagtcagcgcccagacgtacacagagcgatgaacaatttaacaaataagcagtttaaccgtgtgattgcagaaatattattaccattttagaggctggataagaatggtattaggtacagaaccagaagaaactaaaggacaagcggagatgtttgaataatgacaacgaagcagatagtaacagaattgtttggcagtcattggactaccgaagaactaaaaggacttgaaaaatcagttaaaattttgattgaagaagatcgaagacggaggtacgagcaacgtgtgggtaatcaaaaatttagcaaatgataaatattataaaaaattagaggaacacaaccataagttagacgcagaacgtgaagaagctactacgtttgatagccaagaacgagcaatcagcaaagcttcaatcttacatgcagaacttagtacgttaggactaggaattaattttaaagtggaggaaatctaatggtaaaaatttttgaagaagacgatagttacgaactagaaaaggaaatcaacaattttggtaaggacgttcatattaaaaacatttctatttcacgtactgaagttggagactcaacatattatacagcggcggtgttatacgagaaataaaacttataaaattaaaaacaaaggctgtataaaatttacattttattaaggagaagttatggacaaagatttaagaaattttttaatttgtgcattagttatgaatattatgataattcttttcaagtggggatatggagaaataagtacgttcccacaatgggttattttcaccatttcctatgtaggaacgagtgtaggggtttgccttactaccgatatatttagtagaagaaattaaaagaaaacggagaaaacaaacgatgtttaaattgattggaaatgtatcaaaaaaagtatactacgaagcagaaaatgcttctgatttgaacaagtggcgattacataactttattgaagaccgctataaaaaaggtggggcagtaagttcgtacgaagctccagaggccatggtgattgtgaaagctaattctgttaaatcacggagagaatacttgaatgatttattggacgaaggaaagttcgaagaatatcgcaaaataaccatgggaaattccgatcgtgatattgaagtgtatggaagtggtaaagatgacccgaaacttattaatcggcgtaaaaagattgagaagctattcagacaaggagtcacaaataccgctgagattgcaggtgaagtgcgagttgcaagaagtacggtgacccatgaccttagggaattacgtaaaacttatcccgaactaagacaaaaaagagctagatcgtaagattacgtgtaatcaaggaaaaattaatgattaggtagtgaagcttataaaattaatctagtgaggtggaataaacgctatgtcaaaagttaagaagagaattagaccaacaaaagaacaagcccaagaacttaatcgtcggctagatgccgttgtgaaggcaggacatattagcaacttgtactgtgattgtgaagtttgccaagcattagcagaacaagcggagttgatgggatataggacgaactcaactatcaagcagcctgatgcggtgtgggataaacgcaggcgagagtatgagagacggcatcaaattgatgcaatcaaggtggctagcctagcaggccgagggttaacaactgctgagatatgtaagaaaatgaatcattgcaaagcttatattactaagctggctaaagagtttaatattaaaacacatgcaaaaaagagaggtagaaaatcgtgccattaataccagaactggacgagaaaaagactatcaagaatgttaaatacttttttgaagtagagttcccagcaatccagaatatggcacatgtagcttatgttgatataaaatcgccagtaattagtggtatgccttcagtacatggagtagacaatagcaatgaagagaagctcacagcacatgctcaagctaaggacttactagctaaggtattacagtcatgctcaggactagatagagaacatcgacacgtgttggaactacgctacttcaaaaagctaagctggacagcgattgaagatttaactggttacaataacacgcataattgggaacgatgcaatgaagctttattacaattttcgtgggcatttgcggacgttgaagatttaagagtattcaaagatagccaaaaaaacgaataaaatcggaatgaaatgctaataaggttcgctttatattagtattatcgaaagaattgataaatagacacaacatataaaactaataaacgaaactaatatcgatcatttctttcggttgggtgaaatttgggtagtttcaaaagagactaacggttttaagctaacgattcttttcgataaaaaataataggaaatctttgtgcttagtaaggttcgactccttacagtcttatttttataacgctaaagtcacataacttaattgttgtgtggctttttatttaggaataatatattgactttacctgaaattggaggaagttgctatggaaagatataaaaaagataaggttctattaattgtagagaaaggcaatgcaccaattttaattctacagggaaaatcatattcgattacacagttgtcctatcaatatataacaagcacagcaacaatgttaggcactaatagaatagttgctcaatacattgatggcaatggtgtcaaagaagttctgattgataaccagagcggtaatgtagcctatggaaatcaatggggattagattatgccgagagttagaagatgtagacagctaggatgccatgcgatggccactttccctgaccactattgtcagcagcactatgagcatgaagctgagtacttggctagtcggcaacgttgggcacgcagcaatgataaacaatacacacataagtacaatactattactcgctatcgcaacgaagacaagcgtcagcaatacaacttctatcggacaaggcaatggtcacatctaaggcaacgagtcctagagcgtgaccattacttatgtgcttactgcaaagtacaaggcgttatcacacctgctaaaactgttgatcatattgtgccaattgagtttgatgaaacattgaaagctaacgttgataatttagccgttatctgtgggagttgccatcatgctaagacagactgggaacaatcatactatggtactggtcaaggcaacgagttgcaaagcgtaacaccaatcaatgatgtatcgtcaatcgttgtgttgatgaacaattaatttattggcacctgtcgttcgatttaagcgactttaaacttttgagtataattggtcgcaatggtaattaaaacaacccccgcccccttatacggccaaggaagagcacacgccataccgtcgatttgtgatagaaacaatttttgaaaatttttaggtagggggggtcaccaaataacgaaaggaggcatataaaatgaaaaaagtggataaagacgtcaacggcgggcaattatcacgtacaccgccagcctacttaggtcggcaggctaaggtcgtttggcgtcgattagttccctttttagaagacaataccccagttaaacgcattgatagcgggcttgtagagcaatatgcttcccaatacgagatttaccgcaatgcgtataaacacattcaagaaaatggtgaagtccaagcaatctataaaactttacaagaccagaccggtcaaaaaattggtcaagacttcgtaggctacaagcgaaacccgatgacacaaatttacgactcagcggttaaaaatctgactaaactaggcgctgagctaggcttgtcaccaaaatctcgtagtgatttgctcaagttaaacttagatgaccacaaggacaatcgaagcgttgctgatcgaatgaaagagttcttaggtgggtaataaattgaaagggggtgattttacgaatattgaccttactcaatcacacgatgtgctaggagcataccgtgaaattgatgttaaaaatattcgtgatgaatatacagacgcaggaactcaatacgctttagatgttttagatgagaagataactactggttatttgattaagctagcggctttccgccatattagagatttgcaacggcaaggcagcgttgactttccctttgcttattcagtaaaacgagtggatcaagtgcttaaatttgcttctatctgtccgaacgttgatacaggtgaaccaactaagcttatgccgtggcaaaaattcattatggctatgctgattggctggcgtaacgatgacggtggtaaacgtttttcacgtgcgattgtttccgtttcacgtggccaaggtaaaacttaccttatggcgattatcactgcctatagttttctaattgagtcattgggactatctaatcaagactatttagtttcatccattaattacaaacaaactagcaagattctaggctacattaaatcaatgttagccaagattgcaacaattgaaccatttaaaacactaattgaagatagcggattagatacacggacgttgtcgtctcaatctgaccaagttgttatgagtagtaacaataacaaactgcgagcaatcagtcatgaagccggtcagtacgatagttttcatttcacgactgctatttttgatgaaattggtgaaattaagacacggcagaagatttctaaaattgtttcaggccaagttaaggtgcgcaataagcaatttattcaaatttcaacggcgtatcctgatccaaccgtgccattccatgatgatgagcgtatgattcagcaagccatggaacaagattatttacgcgatgctgatacatatttggggcttatttggtcgcaggacaatctagatgaaacttataagcccgatacgtgggttaaaagcaatcccttactagatttaccgagccaacgagaagtgttactgaacggcttgacagataagcgcgattctgacgctttgtcaggcacactcaacgattttcaaaataaaaaccttaacttgtggctagaacaatcgaccgacagctttctcaagttgcctgacgttgaaaaagccattgtgccatcatttagttttgatgaccggcaagtctatatcggctttgactactcgatgtttagtgataacacggcactggcgtttgtattcccttatcgtgataataatggcaaaccacgatggtttatttatcagcatagctttattccatggcagaaagctggttcgattgaagccaaagaaaagcaagatggtattaattatcgggacttagctaaaaagggattttgtacaattagtagccatccacaaggactaatcaatgatgagcaagtttaccagtggttgcttaaatttgttgaacagcatcaactggaagttgttttctttggttatgacgcgtggggactgacacctacaattaaacaattagatttgaattcagggtggccattgcaagccattcggcagcgaactagtgaattgaaagatccaactaagtttttgcagacaatgtttgttgaagggtcagttgaccgcttggatgatcgaattatggaaaaggcgttactaaatgctgaaatttatgaagataaaattggtattcaagtcgataaagctaaggccaccctgaaaattgatgtagttgatgcgttaattgacgccttattccaagccatgtatcactttgaagactttgcagatgtaaacaatcctgacaaacaggtcgaacgcatgaacgaaaaacaagttcttgaatggtttaataacccggaatcgggattgctaggagatgatatgaatgatttttaaacaattttttgcaactatatggcgatactttgatgtgttgtgctttattctaggtatgattgctggggtatatgcagcctttttatttggtcaagcacaaggcgttctagcaattgctgtagcgttgtttttagttggctggctttcagaagtcgtaacagctggccaaaaaggaggtgattaatagtgcctttttttgaaccaccaacagcaataaataattcagttaatattcaaagcgtgccagtagaagacgatgatatcgttaattttctgtcaccaactggcgataatgaatatgttagtgctaaagatgctttggaaaattcggatatttattcagcagttaatcaaatatctggagacttagccacgatacaattaacagccaatatgccacgagcacaaggtattctaaacaatcctagtacgacagctaatggacacacgttttggcagtctatgtattcacaattgttattaggtggtgaatgttttgcatatcgctggcgcaatcctaacggtttagatttacgctgggaatatttacgacctagccaagtgcaaacctacttattagatgatggcagtggtttaacctatacgattacctttgacgagcctgatttaggcgtgcttcaatatgtaccgcagtctgatatgattcatattcgttgggctagtaccgatggtggtatgacaggtaacagtccattaaaagcattatcgagtgagttacaagtcaagagttcatctaacagcttaacgttagctgcattagcacgttcaattagtgcccctggcgtcctatccattcagcatggtggactgctaagcgagaagatgaaggccagccgctcacgcaacttcatgaaacaggtgaacaattcaaacggtggaccggtagttattgatcaacttgaagattacaagccactagaaatgaaagccgatgttactaagctgttaagccaaacagattggacgagcaaacaaattgctaaagtctttggcatacctgatagctatttaaatggtcaaggtgaccagcaaagtaatattgaccaaattaaaggtatgtacaccaatgcccttaaccgctatttacaggcgattttagctgagttggataataagcttaatgctaagataacagccaatatacggactgctgtcgacccattgggagattcgtttgcagctaccttatctgggctaactaaagatggcacaattgctaacaatcaagcaacttggttactacagcagactggttatttcccagatgaaatgcctgctgctaaatcagaaaaaggaggtgataatgatgacaaagaaagtgatgattaaaggcgatattgttgatgatcaaacagccggtttctatcagttcttcggaatgccagcagtatcaccttcgggtgttgctgatattttaaatgatgacagtggcgatgacgatgacgatggtgatgatgaagcacttgaagttgatattgcttccaatggcggtgacgtttttgcagctagtgaaatttacactatgctaaagaattatgctggcaatgtaacagttaatattcaaggcttagcagctagtgcagcaagcgtgattgctatggctggtgatcatatcaacatttcaccaactgctcaaattatgatccacaaggcttggtcacaaccagctggtaatgctgacgatttggagcatgaagccagtgttttaaatggcattgatcaatcaattgccagcgcttatgaagccaaaactgggatggatcaagccgacttactacaattaatggcaaacgaaacatggttaaccgctagtgatgccgtcgataaaggcttcgctgacgaaattatgtttgctaatgaccaacaattgcaaccggtgaatgccatttcacacattccgcctaaagctgcagttaataagctaatgaatttaatttacaaggcggataaggataaagctaagccgtctaaagaagaaaatactactaatagtcaatctgctgaattacgaaacagcaaattggctattttatttgaaaaaaatcaaaaggaggccaactaatggctaatattaacacaatcaatgacgcttggattgctcaaggtcaaaaggtatcagacttaaacgacaaattaaacgcagctgttcttgacgacagctttgatcaagaccaatttaaagcaatgaaacaagaccgtgacaatgcggttgctcgtcgtgacgctttacatgaacaattagaagaagaacgtaaagctcaagaaattgccaatatggaggataaggataagactccacttgatgataaagaaaaagacatcaaagctgagttcattaagaacttccaaggcatgattaaaggtgatcctaaagttatgaacttggtaacttcatctactgacgaagctggcaatgcgattggtttgactattccacaagatattcaaacagcaattaacacattggttcgtaaatacgattcattgcaacaatacgttaaccgagaagctgttgcaactcaatctgggtcacgagtttacgaaaagtggactgacgtcactccattagctgacttagatgatgaaacagctacgattggcgacaatgatgatcctaagctatcaatcatcaaatatacgattcatcgttatgctgggattactactgcaacaaattcattactaaaagatacagccgacaacattttagcttggttatctggatggattgctaagaaagttgttgttacacgcaatgctaagattattgcagcaatgaacgaagcacctaagaaacctagtttggctaagtttgatgacattattactatgattaacactgctgttgatcctgctattaagtcgacatcattcttaatgacaaatacttctggtttaaatgtactttctgaagttaaggatgctatgggacgttacctattacaaccagacccaacacaaccagatcaatacttaatccgtggcaaacgaattgtagaagtagccgacaagtggttacctaacgttggtactacttcagcgccagtttacccactttactacggtgatttatcacaagcggtaactttgtttgaccgtgaaaacctttcattgcttactaccaacattggtggcggtgcgtttgaaaaggatcaaactaagattcgtgtgattgatcgctttgacgttgaagctaccgatgcggatgccttcgtcgctggttcattcagtaaaattgctgaccaaccagccaacttcgctgcaactcctacttcaacgactactacgaccacagcgggataattagctaaccgtgtcgccaataaataaacaatacagtaacaatctgggcggctaagtaaggatgtgataaaatggcagccgatttagaaacgttaaaatcatctttgcggattgacggtaatgatgatgatgagctgctaaaaggctatttgtctgcagccactaactacattaaacaggctattggggacgataatggtgttccgggtttctatgaaatggaaggcgtgagcaacttgtttgaaactgctgtttacgccttagctggttcatactggtattaccggacatcaatcacttcaaacactgttaatccagttgacttagttttggattcaattatcggtcaattgcgaggcctgtatagtcaaaagcaggatgaggtgagcgacaatggcaattaataagttaactccagttgattttaatcaacggatacagattggcacggttaaaactgttcaaaaccctattaatggaacaagtaaacagacatttgttagtcagttcagtttatactgcgcaccctatacacgatcaattgcatcttcgtatcaacttacagctgaacaattggagcaagtagtggtcatcattaggcataatcctaaagtttatgaaggcattaaatgtcagtataaaggtaaactttacgatgttatcaatgacagcatagatgactctagtaattatttatcttgcgattatttgacgctcaaacaggttactaagggggcttagccatggcaaacgataacatagtcgaccaattagaagactggcttaaagatgtccacaagctagtccctgacgaagctgaacaagagaagataacccaagccggcgctaagaagctagctgacaacttaaccgaagttacacgaaagaaacattattcaaaacataaaggtgagaaatacggacacatggctgacaatataagctataacagcaatgacatagacggtgaacatgatggtagttcaattgtcgggtggactaacaagttccatgatatgaatgccaggcggttaaatgatggtacaaaacatattagagctgatcactttgttgatgataatttagctaactcacaagatgatgtatttaacgcaatgctagaggagtataagaaaggggacgatgactagtgctattaccagtatcacaagtatccagcctagttaacgccctcaaatttacgtggctcgataaagtataccttaatgaaatacctaatgaagatttagacaatactactagtacagtcatgctattacaagagactgattcaagcccagtctatcatgcaaacagcacgtttaaaggtctagcaatgggcgttgaaattcaaatattttataagattgacctagccgatgactttaatccgattgaagctgaaatagttttgatgaaagctcttaaagacgctggatggttgattgtagctagccagcaccacacaactgatccagatacaaaccaattgaccaaaacaatttacgtaactaaaaatgaaatgatataaaggagagatttataaatgtcaaaacataatattgttaaagcaacttttgctttattagacgataacggtgacttaattaaagacgctaccaaaggcctatctactgacggaatctatgttgccgatcataacggcgaaggtttcagccaaatcaacgtatctgccattgaagcagctggaactcccggatgggggaatggacaagtcaagcgtacggcttatggtaagtctatgcctacgctggctttaaccgctttagacttagactttaagattaatcaaatgcttaaaggatttacacaaagtgctactacaggtgcatgggtaagacaactacctaagccacatgtggcaatgattgccgaatcacaatcactagatggtgatatctcaatttatgaatgttttaataacattgaattcgttgaagaagcttctaacaactcaactgacactaacagtgaagcagcttactcaacagccctacaaggtactgtattaacaccattgaagcctaacattttcttagctgccaatggcgtacaacaaccttatatgattgcaaagtcaaatgacgctaacttcagtctagataaactttatgctgaaacatttggtggctatactaagccagctagtgcaacaaccgttgtaacacctagtgcagcttctagtgcagcacaacagtaataacaaaaaggcttccctcaaatgggtggccttttaatacatacaaatttaaataaaggggtataaatcaatatgaaaatcaacgctaaaaactactttaaaatcaacaagacggccaatgtaacaccaactaataatatcattcgattagctactaaggttcaaattggtatgttggaatcacaagatactgaaaaagaaatcactgaactagacgccatgaaaaatggcttagaattacaggacgatatgtccgactttgtgcaacgtgtaatgagatacactgatcagcagatggaaacaatcaacgataccatctcagttgaacggtttggcgaaggtgttggttacctaattatgcgcttaaatggtatttcagatgctgatattaagttgtctgaacagaagcaacgtaaagccattgaagacgctaagtcgtcaaaataagccggcacaagcgtaacggtgagcttaaaaaggaagtcttaaagttgaaaaaccaacaggaagacttcaacttactagctcaacaattattaaccgaggggttatcaccgaaagaatttgatgatagttccttttttaatacgatggctagtttaaatgctcgtaaaaaggaagaccgtgctgaactggttgacccactagaggccattaatcaaacgtatggtttataagcgcttgtgccaaaaaggaggttaaagaatggcaaaaaaagtagttggccgtgagatgactagtagggttggcctagatgttgctgaggctgtaaaaccactcaagcagttaaccgccgaggttagagctaacactagtggctggaaagcccaagagacggccttaaaatcagctggtgaatatcaaaaggccgcagcagctagggtagatggcttagtcaaatcaatggaagctcaaaaggctaaaattgatgagttaaagtcccgtcaatcaggcctaaacagagataccaaaaacggtgaagaagcttatttaaaactagctgaccagattaacaaggctagccggtcatacgactcaatgggtggtcaattagatcgggctaagtctaaattacagtattacaattcaggtttagccgacctacaaaagggctataaacagagtacagctttaagtgagtcctatgttaagcgcctagaagccgaaggtaggtcagccgaagctaacaaggctaaattaggtggtttaaaacaggcctatgctaacatggaggctcaatacaaggctcaaactaacgaactggaacggattaagaatgccagtggtgctactagtgacgcttataaacgtcagcaagtgcgggttaatgagactgccacaagcatggctaagctcaaaagtgaaactaatgaattagattcagccatgaagaagtctaatgctagtggcttcactaggatgctagattccgccaagtctaaactaggcttagtccgagatgaagaaaagaaaattaaggacgataccaaacattttgccattggagctgcgattggtaacacaatcagcaatgctgcatctagtgcaattggctacatgaaaggggttaccaaacaaggttatgaactagccgaagctggaggcacgatcaagaagcagtggacaaacttaggtttatccgatgcagatgcaactaaaatgaccaagcaaattggtgatattagaagtaaggcgaacatgtccggcggtgctattgatcaaatgcaaaagaaattctatgcgatgaccaacagcaccaccaaagctcgtgacatgaccgaggtattagctagttatggttcagccgcaggtaaatccggcgaccagatagcccagttgagtaaaggggtagccaagttaagtggtagttctaaagtaacagccagcctatttaagcgtaactttagccaagtacctgaactgcaaaaggccatcattaaagctagtggtatgtcaacagatgcctttaacaagcagttggcagccggtaaaattactggtactcaattgcaaggctatatggtcaaggctgctaaaacaagtggtaaagcatggtcagaatttggagatacaactaagggtaagatggccgccattcaaggtacttacactaacttgaaagtagcgtttgccaaacctttagttgctggtgttgaaaaggctattgatggaatttccgagaagaagggtgctttagataatgttaagaagtctttaaccgatctagttggcacacttggtaagaaaactgggcagtatgtcggtaacgttatcagcttcttagccaagaatgaaaagtcaattgagaagatgggcggtgcagttgctagtattgttggcagtttagctaagggtgtatggtcagctgtagctggtactttaaagctgataggcgggcattctaaggacgcctcaaaaggtatgaatggagtggctgacgctactgcagccattgccaagcataaaggtgccgttgaaaccctaggcaaagctattgtaacttattttgccatttctaaattagcaggtattggtaaggcattcctagggattggtagtggtattggtaaaacaattgaccttattaggtcgctaagcaaggaaaaaaggctagctgctaaagctgataaagaagaaacggccgctcaatggttgcttaatgcagccatggacgctaacccaattggaattgctgtggttgccatagcggccttaacagctggactagtgttagcatacaaacacattaagccgttccgtgaatgggtaaataaagcattcaaatcagtagttaactttggcaagggtattgctaaatggggttcaaatatcggcaagtcgattacccgtgcactaggcaacatgtcgaaaaagtggaatggcttcaagaagagttttggaaagagctggaacaaacactggtcagccatgggtaaatcgctcagaaatagctggaacagttctattaagaatactaaaaaattctttagtaatatagcaaaaggcttttcttcattcgggaagtcttttaaaaaggcatggaatgcatattggaaattcgttcatgatttttacgccaatattttcaatagtatttacaaaaagttcaaatcttggactactacaatatctaaaacatggaccggttttaagaattggttcggtaaaaagtggaaagatatgtggaatggcgttcatgactttttccacggaataactaaacaattaagtaagactttcaataactggacttctggaactatggatgctcttggtagttttggcaataaatttaaatctggttggaatggacttgttaaaggcgttaaggatatcttcagtggtttgtggaaagatcttaaaggcttcgctaaagatggcatgaacgatgtcattgatattatcaacggtgggattaatgcggttgatagtgtcatccatgcttttggtggtaagaaaaagacaattggtgatttaagccatgttcactttgccactggtactggtgtgtttagtgggtcacggaatccgattacacgtcctactatggcaatgttaaatgatggtaacgatagcccccaaactggcaataaagaaatggtcatgctacctaatggtgactcaggtattgttcaaggacgtaacactaagatgatgttaccagctggcactgaggtattgagtgctagtgagacagccatgttaatgagtatacaaggagttaccaagtatgcaaaagggactggcttctttggtgatattttaaacagtgttactagtggtatctcaggtgtggctagttgggtcggcaagaaggttggcagtttggagaagttctttaagaccgctactaacattattgctcacccaattaaatcactcgaaaatctgtttaactggtcttctaaaggcatctcaggtgtcatgagtaacattggtcacggactatttaatggcgttgagaaacaagctaagacgtggtggtcaaacctatggggtatggttaatttaagcggagatggcagtggatcgtacggcggaggctggcaatcaccgggtagtggctggtcacatactgatggttttggttcacctcgtggtggtggtgttcatgatggtaatgacttctctgcaagtgtaggaactgcattccatgctatgcacggtggtacggttatccgtgttggtggtgctccctctggctggggtcctgttggatataacattgttactcgtgattcaactggtaaagaaattatttaccaagaatttggaaatgcaaaagacgttaaggttcatcaaggacagcatgttaaaactggcgatacactgggtgttctaggacgttcagggcttggaactgggcctcacttacacgttggcttaacaagcggtggttcagtttggggcagaaatggtatgagtaccaaaggctggcttgatattactaaacagcatggtaaagataaaggctctgatgctggcagtgatactaataactcactccaaaagataatcaagaagcaagttggcggtggattctggaagtttatcagcaagattgccagcatgtttggtgatgatggcggaagtggtgaccccggtggttcaggtgtacaacgttggaaatctgacgttaaaagtgcattgagtaagcttggactttcaaccagtgaaagcatggttagccgagtgctacggcagattaatactgaatctggtggtaaccctaaagctatgggtggtactgatggtttagctgacgggcatgcagaaggattgatgcaagttaagccggggacatttagtgcctatcatttacctgggcatgacgatatctggaatggttatgacaatatgctagctggcttaaactatgcaaagcatcggtacggtagcggattgagtttccttggtaacgggcatggttacgagtacggtggcatcatcaacactaaccagttaattgaagtcgctgaacacaataaacccgaaatggtgttaccattgaccaataagagtcgggctaaccaattaatcacgcaggctaaccaaattgtaaatggcaacaatggtagccaagttacatctaataatagtgaaagcaatgataaacttgataaactaattagcctaatgtccgccattctaggtaacatgggcaatgtacaagcagtcattgctaaatctgacgtggttaatgccgtcaaatcggacaataagacagcttcacaatactcgcaaatgatggggtactaatatcctaatcaaccaaagggtcgcccttaattgggcgccctttttacatatctaaatttaaaaaggaggttaaatcgtgactttacaacgagatgattttgaatatgccggtttaaatagtcgggatgatttacaagttgagatgggtaacgtggtattacctagcgctccagccatggctgaacaagtgactgacataccggccatgtatggtaaccaatttaatggcacggattttactagtcggacgattagtataccaatatccatttattgtgctgataatcaagacaaatttaatcagaaaatgcacaatttaagcgggttgctgttaagtgatgaccctagtgataatggtaaagaatatccactagtgtttggctttgaacctaaggtaacttattgggggcatattaccgcaattagtgatccaaccccgattaacacgggtatgtatgatatgacgcttacaattacttttgtacagtctgatccacgtgcaaccctgccacaagttgagaagcctttaaataacggcttaaatacaattactgtagacggtacggcacgaacagcgccagttgttcaagtcattcctaaacgaccgttaaaatacattgggtttaatcttaatggcggtcaatttggtttaggacctgaatctcctgatgatcaagctagtgctattcaaaccgatacaagtatacttaatgaccctattgccagtatggcaatgtggactaatgacgctaatgccattagtggtattaagactgatgacaattataagtttcaaggtagtgctgaaatcaataacgatacatcggtaatgaaagtggcaattgtgaatggcaaaaaagattttggaccaataccaactgctccacaagatgcaccgtggataggcccaacttatcggtatactgggatgacacaggctttaaccaactatcgtgtacgtgctggattacatcatatgagatattcaggtacgcataacggtcgggcaatgggaaaagtacaattgtcattacttgatcctagtggtaacatgctcggccggtttatgattggtgaccacatgcaaggtggtaaaacctatgtgacgctgcaattgtacaagccgggaactgcatttaaagatgcccacaaaacactttactggggatattgtccaagcggtgcatttgccaataaaaaagacgaaaaagttaagattaaaactggaacaaccactaaaacagtgattaaaaaaagcaggtctaagcgtggcaaggtaacgaaaaaatcaatcaaagagactgtaaataagtatacgacaaccgttaacaaagaagaaagcgactgtttaactaatgcttgggtatttatggacttgacaaagtccggcaatgtttatacatgggaattacaccaatacagtcttcgtgatgctcagccttatcacgataaagataagtatttaattgcaagtggtcgctgggtagataaaaacaatgaatacgaggcagccttaggtggatttgggcaaacattcctcaaaaaccctattacagaagactttaacaaagtgctgtacatggcaccgtacatgactctcaccgatttacaagtatggaaccataaacagccacaaccgactgaaccgacttacattgccaatgcaggggaagaaatcgtcatggattgtgaaactgataccgtaactgttaacggtcgtttggtatcaccagtatggtcaactgattatccgcaattgaagtcgggtgttaatggattaaccatggttggtgacctagacgacgctaaaatgacgcttaaatacctgccaaaactactataacaatataaggaggcaatgatggctttaaccaatcaatatttaattttaaatccaagtttaaagcggattggcacactaaccgtcgatggtgctactaaattttcaaatgacagcgtcaaaattcaacttgccgatgcagatacaactagtacatcctacgatgatgacgccaatgttggaactaaagacagctacaccggtacgattaacttaaatgctcagtctaagaagtttgaccaccaaggatcattagacgtgcttcaaggtcaaaacgactcgggcaaagtagttgctggcaataatctagcttattatgacgctttgtcggggcgttggtatgtaatgcacatttatagtgttgatgaaagtaatacctcggctactaagcatgtcacaaccgctaactttactaatttgtgcctattcacgttagcacaccattatccaatagcaatggctgagtcagatatagatattaagtccgcttttacaagtgtattcagtgataccggctggacgcttaaatttaatacaactaatgtaatgactccacatatatcaattgatggaaagactaaagcgtcagcgctattacaaacgttattgcaagcctatgatgtggaagtcgattgctatgttgagattgactcacaaggtaacgttcaatcgaagacttgtgaaattgttgatcagttgaatgccgacaaggtttataatgaggcaatctttggtaaaaatattactagtataaaacgaacgaccgtttcaacaccgatcactaaactgattgcttatggcgctaacggtagtaccatggccgctgacaatgatggaaaagtttacattgttgatgatgaagctaaccagcaatacaatcctgattggcaaagcgggctttattatgagggtgtaattactgccaatacaattgaccacgcagctggtttaaaatcgtgggctgaacaaatgctacaacttttcaatcatccgagaacctattatgaggttaatgtgtcaccaacttttaatccgccattaggtgctaccattcgatttaaggatgacaaaatcacgccggtcctagatgccagcggtcgggtaatccaacgaacaatcagctttgccaatccatatggtaataccgttggttttggtgaatacgtcacggtgccagttgccacaccagcttggttagtgggctatcaaagtgctattagtagtgctattgaaaaagcaagggagaacgccagctcggttaaaccggttgctttgactccagacggtaacaactttactgatcccagccagactaagcgactaattttacaggcttgggaaggcaacactaatatttcagcctatattgataacaatggatttatttggcgtcgatataatactgatggcacggttgataccagctatgaaagcactggatatttaatacaggcaccatatagtgctgtaggtacactgcacggaacgatcgagactagttacattcaagacgaaccagaggttaagttacaaacaagtgctattagtaacttgggcagttttagcccagacaacagtaccctaggaataactggcgcagcacaatatatgtgtcctttgagtaccggccagtatatgactagccgagcacaagcaaataacgatgttatgttcgtcttacatgatactaattttaatccaattagcaagatgattgtttcacaaggtggacacggagctagtttttcaatcgaagaagtaaatgggacggtttatatttggtacgcagtcaagtctagttcaaacactgaccaatttgcgattagtcgtattccatacctcgctaacgttactctaagcaatgatgatactcgtattactagattttgcactgttaatcgttatataagaatgaatgttgacttcaaacatggatatgtattatgtagttactttaatggtgaacagaatgtgctacgactcgatgatgttaagcaaggtaattataacgtattatatagttttgacgctactaactatgggtttaacccgaaccagcaaacctatcaatcacaaggcattgattttccatatgtgtactttcaatcgggtgattataacatgaaagaccctcgtatggtgtacgcagttaatgttattcatggtgggcaagaattcgcctctaactacttgctggatatggatttagggttaaccgatgacgttgccgaacctgaaacgtgtaatattatctataaccagaataaccagccggagctattagttacctttaattgtggttctttagaacgcgcctttgtaataccaattaaagaacgtttgccaatgattgaggagggaggtgaataaaatggcagaatctaatccaactcaggtcattctaacagatgatggcctcaaaattatcaaagcgcaaaataccgctaatgaagcagtgggtaacgtaaatgatattaatagtgataacaagcttactcctagcgaaaaattaaaattaaaacaagaatatgataaagatgttgagctttataacattgatatcgaacaattaaaatccgttgatttacctacagcagaattagaaactgctatgagtaatttgacggattttctaactccattgttcaaagaaatgaatagaacttcaactgtagacagaaacactttagatagtgtatttacatcctttgctacggcagataagaacgcctctcaagcatttgtaaatatggttcaacaagtagcagatgatgctaaaaaagctggagatgatgcaaaggaagccggcgagaaagcacaagaagccggggaagaagctaaagcatcagctgatcaagccaaagtggatgccactcaagcgaaagcagacgcagctaccgctcaacagaaagctcaatccagtattgaccaatttaatgaagccaaaacgcagattaatagtgagattaccgatgctaaaaatagtgctaaacaagctttagataacatcacggtagtcgattccaaagttgataaattatcaacttcaactacggctcaattcaatactttgaataatggttatcaagaagtgattagcacagtcgacaatatggatattggtggtcgaaatattgttcttgatagtagtaatatggggagctttagaatctggcaagcagatggtaattctaagctttcagatgataaaaaagaagtaactataactacttcacacggtggaattaacattgaaaagaaaaatttatcggaatatcttcccaacaagggagatacaattgtaatttcggccgatgttaaaggcaattcacatcttcaatttaactataataatggaaataattttgttggatctggtactagtattactgttacgacagagtacaaaaggtatttcacaacatttgaatggaatcctatgaatttagataaaaccgagtttgttatttatgcagcgggtagtgcagaacaatatttaacggttaaaaatgtgaaggtagaaataggtaataaagctactgattggtcaccagcaccagaagatttagctagtcaaacacagattacagctttaaataatttaatcagtcaaaaggtttcaaatgaccaatatcaaagtgataaaacacaaacagctaacttaatcagtcaaacggttacgaatgctgttagtaatatcagtgtcggtggcactaatcttcttaaaaatagcaagtttgatgacaatatgaataactggcatatctggtgtccgaaaggtatggggacaagtacggttcaaattaatccaactggtggtgtcggtgattggccaagacaggcaatctatttagctaagattatcaacccccaagcggacaaaaataatcaatttggtattgctcaagacaatattccggtagaacccaacgctgaatacacatttcagttgtttaatgatggtatcgatccaattaccgtacagcatgggaatggtagtaatgatccatatgtgtcaaaagttcttggcagtcttagaacaacttggacttttaaaattccagcaggcgtatataacactaatatctatattggtttcgattcggggcaatcgggtacagcttggatatctttaacaaaacttgaaaaaggtaataaagtcactgattggagtttatctccatttgatacagcaactagcactgaaattgatcaaattaataatgcaattaaattaaaagcagactctagtgatgtaacctcacaaattaatgtagcaattcaaggggtccaaactgatgtaacaaataaagttagcaatttaaatactcaaattagtcaaacatcagatgcggttcaaattttagctagcacagcgggcagtaaaaaccttgtatataatgcaacgtttgaacaaattacaaatggttttcctaccggttggaccaagattggtaatgcttctaatgagacaggatatgtttcaggtgctccagcatcttcatatcagggtagaccttcgattgggataaacacctcaaaagaaatgggctggttaatgtttgcacaatcagacccacaaccattgccggtcgacaatagcacagatgccataaataacgtctatagtgcttcaatgatggttaaggcatacggtgatggtggagctaaagcaagcggacatgtttttattactctagctttttttgatgctaacaaggtacgaatcgaggacaacgtcaagggtacttggtcacaaaccgcaaccgatagtaatgaacagtggcaattagttaaagttgaaaattcagttcctccagcaaatgcaaaatacgtaggtattcaagcattcacttatagcgtaccaacacatgcaatgattaaccagccgatgattaatattggagcaacagtacaacctttcaaacccgacatggtcaatcaagcttctattacggcttcaattaatgatattaatttaaaggtttcaaactcagatggttcttcatcacaagtagatatcaataacgatacgattttattggatgctaataaaattatctttaatggtaatacaagcattcaaaatggaactattggtacagctaagattgccaatgcggctatcaatacagcacagattgcagatggggcgattaacaacgctaaaattgcaaacgcagctattaatgatgccaagatatcgaatctgaatggtaacaagattgttgctggcagtattactgctgacaagattaatgttgacgacttaattgctaatggtattaatactaaaacgttaacgtcggttaatattaacacccccaatcttaatctgggtgataacggtcaaattattggcaactatagcgttaatgatgataccggatggtttcaaccgattaatggttctggtacattacaaatttcaaatggctatatccgatcaacggcaaacattctctactataacaagatcctaaacggaattggcggtgacaaatggggacattgggcaagctcaacacagtttgttccagccccagaccaagctcatccagatattggtaatatagccgaatcaacttttacaccggcatttctaaagcttgatatttttgaagctgataagtccaaagttaattctcgtgtttatattgatggaaccggattgtatatcaatgacggtggcacacaagcagtttcagcaatgctttcggattacgaactcatatcaagcggcatggcatatcttaatagcggcattcaaatgaaacagggagcatcatttacattcggcaatttagctatgaatggcagccacacaattgctatgcttgatagtaatgcattgtatttttcagacaaagtgagtggagatggtaacccaatcgaaattaaagccaaggcgtttaccaaggcgtcacgattgagtatcaagcacgatatcaggccattaagcaccactgaatcgtcacgcttgcttaatgctattgatgtagaaaagttccggtatactcatgatggtgccacatacaagtatcagtatggtggtgtgattgatgacgttaacagccttggcagcaagcagtacagtatgccacccgaactacttagtgaagacggtactggaattaacttagacagtttgaccggaattcttgtcaagcgagtacaagatcaagataaaacgattgctgaactaagcatgagattaactaaattggagatggaaaaatgaacgaaataaacattacttatatgacgcccaataccgacaacttaaccactagaattgaatttactgctaaatttcaaggaaccaatgataatgtttctggaagtatcaacgtgaacaacgatgatattaccaacgcttatcatgcggcgacagctagtgatccatatgctggacataggactttagtcgccagtaaattagcagccgaatttaaacaagtaaccaacacaacggaggcttaaatcatggatatcgatgcacaagctttgattaacaaactaacaagcaactatgctcaatcaattgcccttaaagaccaacaactagcgatggcacaagttcaaattgatcagcttaatgccaagttggctgagaaggaggcgcctaaagatggcgaaaatgcttagttttaccgatacttcaccacaaacggttaaaattggtgatactaccactagctttacgttaatttgtggtaatgataatgtggccactgatttaactaatgccacttcaattaccgttaaattgggcaatgatagtggttatcttaaatcggctacagttaatccagctagcttaacagatccaacgactggccagattgtgctagctttaacagcagatttaatgaccggcttaacagcaggagattatcaactagaagtatgggtggttgatagtaccgggacatcaatttaccctagtgagtcaacgttacagttcaaaattaataatagtcttgaataggaggcaaataattgaataagcgaaaattgaaggcactcatcttaatggtgagcgctatttttatggcctttttattgggcaatactaccagtcatgctgctcgcatggatatggtcgatgtgtcgaataacaacggatacatgtcaacggcagagtatgtttcgatgcgtaacgagttcggtgttaaggctgttacggtcaaaattagtgaaggtggtgcgtacaaggatccgtatgctgccagcaacattgcaaatgtccaagcggcgggaatgtatattaatggttaccattttgcacactacgctactaaggcacaagcaatcaccgaagctgattttgctgggagaacagctaaagcggcagggttgccagttggagcggtactagcaactgacgtcgaagctgaggaacagaattaccaatccagagcaaccaacgacgtcaataacaaagcgttcatgcaagagattcagaagtttggttatcgggccgacatttatacgtcagggtcatgggctaacactaaaatgaccatcaagggcaaaaccggctggattgctgcttacccgtatgtggttagcggtaagaactggtattcaactaaccacgcatggcaatggtcgtcaacggctaaattccgtattagctatggtggatttgacgttagccaattaaatgacaactactacaccgcggggctgaaatcaacagtcaagccgactaataaaggtgcagttaaggccaacaacaaaaaagcaaacaaacgcacttacaagcaatctgcgtcatccaagtgggtcaaggaagctaaaacttacacactcaagacggcggttaagctgcacacaagcacgtcaacatcatcaaatgtgattactattttgccagcggggactacggtaaagactgatcaagccattattaagggcgggtatcgctgggtacgtcagccgcgttcttatggctatggctatttagcaaccggcccgacaagtaatacactggaatatgtaaagagtggtacagctcacacgtattacacagttaagtatggcgacagttggtggacaatcgcacaacgcaacggcctaagtatgaatactttagctagtcagaatggaaagacgatttataccactatctatcccggtcagcgtttggtggtgagataatggcacaatacgatgatacaactaagctattaatggatattcaaaaggacgtgaccaccaccaaaacgaaagttgagaacatcgaagaaaagttaaatcaagttgacgatattggcaacaaagcagaaaaggcactagccaaatcaattgaggtcgaacatgagataggacggattactcagattcagaattgggttatcggtgtcttgattagtggcgtgctcgtcacgttagttatttatatcgcagagaaatttttataggaggatattatgaaaaaaattagttttaagaatgctgatggtagtttgaatggtaaattgattgctgggattatttcgttactaatcgttttgattcaacaagtatttgccgtttttggcattaagtttactggcgattggtcagcaattgctggaattattaacaccgtattaacaattcttggtatgttaggtgttattactgacgttcaaacagtgacagcaccaacagttaaaagtgacgaagaaagccaagttgaagcgaccgctaatgaagttgctaacgaaataccagcaccaacttccgcagccactacagtgaatagttctaaagcatctgacactgaatccgcctcacaagcaagtcaaaaatagtataattaatcccctgcgcttcggcgtgggggattttttgtgtttaaccgttgacaattgtcatatataatattacattgtggtcaagagtctaataaacaagggagataattttaaatgttcgagaatctagttaaattagctggtttaagtcggtggtatcaccatgaacaacatgcagataaatcaaacgcccgtaaagctagtggtcagtcagccttttcatatgatgattttaaaggattacgtaagttggcattctggctatttgtgttcagcatattcctaaattggggctttgttggtgcagttagcttgattgcatggttagccatgtgggttgttagcttactgttttaaacagcgttaattaaatgtcgtcccgtaacttgtcaaagttacattcgggggtttattgataggaacagaaccgttcacaaactacgcaacgtgctaactacctcggaacatgtgctgataatggttcagttgctggttatgacaactgggcaggaatgttaggcgaacctttggatagattacagattcatattaatgataatagcaagtattaatatagagtgtgttttatttgaatatttaaatttaaaatgttagagttactttacccccaggattttgaacgttatatcgaaaccctgttaaaaagcctgttcagtttaaatgctgagcaggcttttttgctatggcgaataagattataaaatgtactgtaagtaatttatatttacgctatcagtattttatgtaacgtgtgtacaataaaaatagacgaatttagttaattatgttaaattgaatacattcctcgatttgaatactgtagctgaatacagcgaaagcctcctagtgaacgctagggggctttctttaatgtaatcaaaggactataataaggttgtaagctaagttcctccaaagaatattaagcttgccagagaatcaccagccaataaataggttgcgtgattttttgtttgtaactttattttgacgcttgaaaacacacgtttttatgattgaaacggaagtttttcaaaatataaataaagatacgggaattattgtagaacaaaatcaaaagcattaccaataaaaacaattgggtgacttctgctgatctttttttaaaggcaatgtagaagcaacctgatagcaccgattaaaaactacattgtaactagtttaaaaccgtagccggccaagctaaacggttttttatttgtctagtaaacaaaaaactactcaatccttaactgggatgagcagtttttttattgtctattattagcatgagccactttaatttttttggggacattttggggacatacccccatttttgtatagatttacacagtctcttaaaaataagaaacggctatacaatagtgtttatcgtctattaaaaatattcgaatctttaatactgaattagcaaaactcgatgagtatattgctaattttgaagagatatacggcattagtttagatcctattcagcgtaaaaaatttgcttattggctagcaattaccttagaacgaagccagattgcaccactaaatatgaagatcgccaagaagcaaatcattgataacgatcctaattttgatttaatgtggcaatggaacaaaaaaggagaactcaccttaaatcaagatgagttatattttttgtatcaagttatatatgtatttggaattatcgatggtaatccaaattatgagaatagatatgcattagcacaccagaaaaatcaaacgcatgcctatcaggccgtaatgaatttggcattggtcattaaaaaaacatttaacttccagttaggaaccacggatttagaactaatgtttaattttatagcatttcatgaacgtagtacttttttttatggaaattctgacgtgtttttcaaccgttcttacataatggagttgaaagaagaacatcctagaaaatatcaaattatgcaaaaattaaaggaacagttagttaaacattctaaccaatcagttactaacttattagctaattgggaacaattatttttgaattattacttcatcttagattactatgatctgttcgcaaaaaaagttacaccagttaaaattctagtacaagacgacttacaccatacgcatcgactatggttgatgaacaaaattcgtgcttactttggtcattcttttgcttttgaattttacgactataaaacaccagtttcaaaagtagatttggtaatttctaattactatattgatactaaaaattgtccacttattttaatgaaaaacttacctacagaacgtaattggcggcagttaggcgcaatgctttatcgcttaaccaaataaaagatgtaattaggttaattgcatctttttttattgcctaaaacactttaatttttttcagaatcaagaaaaaaattagactagtaagttcctcagatgacatgcgaaaataattttaaatcaaatgattgattagatttgagggggaagtatgcaatgaataaaatgatgctaacgacaattgcaatcggtgtgtttgcgataaacaccaatacagcaatggcttcacaaatatcagaagcaacgaatcacacggatgtaactttaacagctggttctggaaaggatgtttatcctgttgtgcccgatgatacccatgacgatgactcgggaacaggagacatggggtcactaacaatcccgtatgcttcaaacattacattcggagaacatgaaattaagcaagcagacgcggattactacgccttaaaccaaaaaccacatgttcaagttaatgacactcgtggtggtgcaaaaggttggtctttaggggttgcaattacaccttttgtaggtgctaatggaaaagaactcgtaggtgcccagatgtccttatctaatgggaaggtggtaactaagaataataaatcggccatgccaaaaatcactcaagatagctttaaattaaatcgagcatatcaagtggtaatgactgctaaggaaggcgaaggagcgggggcttttgcagctgtttttgaaggtaaaaatggtaataacgaaaatgttaaactccacgtaccacgtgcaggagttgaagcgcaaagttattcagccgagttaacttgggtattgaccgatgcgccatcttagtataaataatcagcacattaagagtagattacttagtattattctaatttatataatgacgttgctgctaacacttatttttccaaattcaattagtgcaagcggaaaagtaagtaatcaagtaacgtttaatgctgaagcaattttaccgaaaaatcagcattccgaagttagttactacgacttacgggtacgtccaggagctacgcaaaagttatttattcgacttcgtaacttaaccaatgcagagcaaaccattatggttaaaactaataatgcgataactaatcagaatggagctattgattattctaaatcaaacgccccattactaggcggccctacttttaaacagcttatttcaggaccacaaacggtcttacttaagcctaaggaagttcgaagagttagctttcagttgaagattccaccaaaaggttttaaaggaacggttttaggaggattttattgttacacaaaaccagttaagactgccactagtgcatcaggtttaagtttgaccaataattttgcttataccattggcgcaaagttagagtgtgcaaactctaaaatacaacctaagttaagtttgataaaggctataccaggattagataatggctatttatcagtttttgctactttacaaaatgtagctcctgtattgttgagtaaattagacatgcgggctaccgtaaccaaaaaaaatcaccatgaaattttaaagagaacgcataagaagatctcgattgcaccgcgaacacgttttcgactacccattagttggaatgatgaacccttaaaaagtggaagatatgtgttaaccattgatttaagtagttctacgggcaagaaatggcaacttattcaggaatttaaaattacaggagacgatgccaaattaaatcaaaaggctgttgaacttaaaaaaacagataataaactgttttatctaataataggacttttggttggaataattgtaattttgagcggttatatttattacgtaaaacagaaaaataataaaacggagaagtaagatgaaattttggggaggaataatattatttacattaatacttaacattaatggaattgcgttagctaacgaacctactaatagtaaaatcgggattactttttatcaaaatgacgctgctagccaagttgtaccaatgcaaaaagtcgctcaacccactaagaaaagtccaaaacaaaccgctactccaagtaccagaccacaatatttaccacaaactagtgaagatattgcgatggggatggtttggattgggttaggtttgatttgctatatactgatcaaaaatggaattaaaaaaattcttgtgagtaagaggacgactaatgaaaaaagttaaaggtttgttattagtggcttttctcgtaagtttctgctggatagctaccgacgtaaaggctagcttgaagccattatctaatcttgaaaattttcagtgggccaatcaagcagttacgccagctgaaaatacctttataatgcatagtggtgctcgaacaaaggtgactcctttaaagggcgatgctaccacgaatcggctatcagttgatcagaaaataaatgtgagtcaggccctcgtagaaaatgttgggttttatcaaggtaaatctgtaaatttgctggtaacgttgaaacgaaataaaagtaatttaaagggcggatcactaagctttgctaaggattattttttgggaattgatattgctggtgaagtaatggttacttatcaatttattgacgccaatcaaaatcctctgacgattaaaacagcatttaattacttcggtcttaattccaataagtacattggataccaagattacaattctgtaattagtgcggtttacgcaaataacccgactaatatcaggtatgaatcagaaaatcaatggatgtatttaaaaaatactacagttgggattccgtggcgagatccgcgccaaagttttgaagtagttactaaacccatttcccaagttacttttgcggtacacaataatgacagtacaccttcatcgttagtttatttaactgaatttttagcaaggcctgagtctgcgccagcttatgcggaaagtagcgattttaaccaagctaataatggcgtctatttggcagctcaacagatggtacctagtactgatagtttcacatctgaggttagttttaatttggaacatgtttataatagtgaacaatatattccagaacggattaaagttactaattttgatgggaaagatgtaacgcaatactttgattggcgaattgagaatcagaaagtctacatcaagactaggccagctgctactaaagcaataaccgatactacgttgcattataaagtatatttaaagtggcttgaagctaaaaaaactgtagatccaactcgggttgttaacggaaaattagatttaccgtttgacgtatcaacgaacatcaatgggcaagctgtaggtaaaagtagcgcagtttcgactgtagactatgttggtagggtgaatgttgtttttttagcggacaatggtttcgaggtacttcgcgctcgagaagttaaaagtggcattttaaccacgaaatttgacgtgactgatatatatcctgaaattgcaggttacattcccatcaagaatgatgcagttcaagatactggtacattcttaccaggaaataaaacaatcattcaccggtaccgtaaaggcgaaaaacttagttttaaactaaaaaatctaggagatacactctatatttcacgattttctaatcaaagcaaacttacattttcctttacgcacgaagatggagcaaaagttagattggtaggaaactgcgcgggagaaaagcgaatactaaaagagtattccaacgctgctcatcaggttgatgatgaaattatatgccaatttccaaagtcatggattaataaaaaggtagatttttacctcgaatatgaccaacatcaaatgtcgaataaagaaactcggataattaaacaagaacgcggaccggagctgtcattacctagtaaaatcgactttggttcgcacgaaattccgctggaaattacggtctgttcactaactagagcagagtgggtacatgttaaagatcgtagtgagcttgaccactacccgtggattttaaaggttcgagaagaacatccactaactaaccaaaacgaccagaagcttatatcaaggctttattttaagggtaacgtaatcaacggagaaaatcagacgattgggcaagatactgggaacttaaatttagatttaagccagtatctccaactggtgctagaacctacggatcaaattggtagttaccatggtgaattaagatggacattggaagatgcccccaactgattaatattttttcaagcaagctgaatcagaaacttcatgagactagctaaccaatcctttagttttggttagctagttttttagtacccagagattatattgcaacggtaaacataaatttcagttataatcgtccgaaaatagttaacgttgtgattcgattagcactttacttaacagagtgctaaaaaggagttataatacagttgtaagtgaaaaagagtgtttttacttagttttaagacacaattttacttgatttaattaacggaggtgttgttatatggccaatttttacggaaatgatccttttttcaacaatgatatggatgatatttttaatcaagtatttaaacgtatggggaatcctaactcagattctgcccgctacttggttaatggtcaatcgttaactccagatgagtttgctcaatatcgagcgactggtaaattaccagaacaagcaaaaacaattgaagtatctaaagatggacaacaagctcttaaaaagggtggtattttagaaaaactaggcaccaacttaacagaacaagcacgcgatggattactagattcagttattggacgtgaaaatgaaattcaagaaacagcggaaattttaagccgtcgaaccaaaaataatccaattttagttggggatgcaggtgttggtaaaacagccatcgttgaaggactggctcaagcaattgtaaatggtaaagttccagaagcaattcgggacaaagaaatttactctattgacttgtcctccttagaagctggaactcaatatcgcggttcttttgaagagaatatcaaagacttagtcaaggaagttaaggctgctggcaatattattctattctttgatgaaatccaccagataattggtactggttcaacaggtggtgaagacggtggtaaaggcttagctgatattatcaagccagcattgtctcgtggtgaactaaccgttattggcgccactacccaagatgaatatcgaaatacaattttgaaaaacgcagctttggctcgtcgattcaatgatgttgtagtcaatgaacctaatgctgaagacacgcttgaaattctaaagggtatcaaaaacttgtatgaggaacatcaccatgtaaaattgccagatgatgttttgaaggcaacggtagattactccatccaatatattccacaaagaacgctaccagataaagcaattgatttgattgatatgacagcggctcatttggcagcacatcagcctgaaaatgatgaaacagctttaaaggaaaagctcaatcaattgcaaaaagaaaaagatcaagcggtggaaaaagaagactttaagcgggctgcggatttgaagcaacaaatcgaggctactaataagcaaattgataatgtaggtaagaaggaagaagtagtggctaccgtcgatgatgttgctcaatcagtagaacgattaacgggaattccagtctcagatatgggtgctaatgatattgaacggttaaaagatttggatagtcgcttaaagagtaaagttatcggtcaagatgaagcggtagcaatggttgctagagctattcgtcggaatcgagcaggcttttcagaaggtgaacagcctattggtagtttcctatttgttggtccaaccggggttggtaaaactgaattagctaaacaattagcattagacatgtttggtgataaggatgcaatcattcgattggatatgagtgagtattcagatcggaccgctgtttcaaaattaattggtacatcagctggttatgtaggctatgatgataactctaataccttaacggaaagagtacgtcgaaatccttattcaatcgtattactagatgaaattgaaaaagccgatccacaagtattgacgcttttgcttcaggtaatggatgacggtcgtttgacggatggtcaaggtaatgtaattaacttcaagaataccattattattgctacatccaatgctggatttggtaatgaaaagttaactggtgatgcagacaaagaccaaactttaatggataagttggctccattcttccgtccagaattcctaaaccggttcaatggaatcgttgaattctcacatctaactaagaaagatttaagtcagattgttgatttaatgatttctgatgttcaaaaaacactagcgaaaaaggatttgactttgaaagtaaccgatgcagctaaggattggttgatggaacaaggatatgacgaagcaatgggagctcgtccattaagaagggtgattgaacaacaaattcgtgataaggtaacagatttctatttagatcatttggatattaagcatttaaaagctgatttgaaggatgatcaaatcgtgattgagcaagcctaacttagcagacagcttactttgggctttgtttacgaaaagcgaggatgacagattaatttctgtgatcttcgctttttattttggttttggttcagaatgaggattattggttttgttattttaataactaaaatttgtctcagttcagaaaatattttttcaaaaataaagttatgtcggttaccaatttagctaaaggtaagaattagtaatcttaaaactttatccattcaatccaaaaaccaaaactgaaaaaaccatgctaaaataaagagtattagattaacagtagcttagtttaaatataaaaaatggcataaaaagcccaacgaaataggagttaaacaaacatggcaattatccaatggtaccctggccatatggcgaaggcaattcgtcaggtcgaagaaaaattaaaactagttgatatcgtatttgaactagtagacgcacggatcccagtgtcgtcacgaaatccaatgattgaagatgttattaaaagtaaacctcatcttttaatcttaacgaaggctgatttagcagatcctaaagaaactaaaaaatggctagattactataaatcacggaacgaatatgctatcgcattgaattctaaagagccctcaactgaaaatatcattttgaagaaaacgcaagaaattttagccgacaagctagctaataaggctgatcgtggaattaagaatgctgaaattcggtccatgtgtattggaatccccaacgttggtaaatctacgttgcttaaccacttagttaataagaaagtggcaattacaggcgaccgccctggggtaacgaaaaaacaacaatggttgcgttcacgtcgcggactatatcttttagatactcccggaattttatggcctaaatttgaagaccaaaacgtaggaaataaattggcctttactggagcgattaaagataatttattcgctaacgacgatgttgtaatctatggtctaaatatattcatcaaccattatcgtgaaggattgatggaacgttatcatttaacagaagacgatttagaaatggaattacctgaattgttactactaattactcaaaaattagggatgcgtgacgactacgatcgtgctagtcagcgaatcttgttagacgcacgtaaaggaaaactgggccgtttcactttagactttgtagaggagtttaaagaccttggcgacgattaaggaaattaagacgcagcttttaagtgtttatacactagatgacccattattagttgaactttcagaagatccgcgaactggtgttcaacgcttaattaaacataaacaaaaggaaattaatcaattaagattaaaagaagaagcatttcaagcacgatttacgttagaacgagaattatggtcaaatggaattgacttagtagcggggattgatgaagtgggtcggggatgtttagcgggtccggtcgtcactgccagtgtagtcttggatgaaactttcgatttaatcgacgttaatgactctaagcagctcagtagtgaattgcgagaggaattatatgccaaaatccttacagaggctgtgagcgtcggtattggcgtctgttctaaccaaaaaattgatgaagttaatattttaaatgctacaaaacttgcgatgcgagaagcagtgggtaacttaaatgttactccacaacatttgttgattgatgcagtcaatgcgccaatagaaatcccaaaagctgtgatgtttaagggtgattctaaaagtatcagtattgcagccgcttcaattgttgccaaggtatatcgtgaccatctaatgcgttcttatgctgcaatctatccaggctacggatttgataaaaacgtgggttacggtactaagcaacatattgaggggttaaaaacttatggggtaactcccatccatcgtcagacttttgaaccggtacctgaatttttaataaaataaattaacctaaaaacacgtaaagtacatttgaggtgatcaaatggaaatacgtgattttttgattagagtaaaagtgggtacgaatttaggcattaaaaagcagtatcaaatttaccaagaaattcgtaaaagtcccaatttatccattgcagagtggattgaaacaacgaaactaattaaggaaagtcaaaaagatgaattaactgccacattacaaagtgaacaactaacccacgaaatccaaattaatgaacaaagtgcgggaattctaaccattctagatgaaatgtaccctaagctactacgggagatatattgcccaccgacagttttgttttacaatggaaatctatcgctactaagccatcaacgtgctattgcaattgtaggcgccaggatgatgacgagttatggtgaacaagccattaaatgtttaattccgggcgtagtagctaatcaattaaccaccgttagtggtttagctaaaggagttgatgcgttggttcacgaagcaactttagcaaacgcagggtctaccattgccgtaattggaaatgggctcgatatcacctaccctaagcaaaacgctcagcttcaaaatcaaattcaaaaagaaggtttaattctgagtgaatatcctcggggagctcgaccattaagacatcattttgtagaacgtaaccgaattattgccggattgaccaccgcaacatgcgtagtggaagcaagaaagaattctgggagcttaatcacggctagtctggcactcacggaaaatcgaaatgttttagcaattccggggagtattttcagtggtaatagtcaagggaccaaccagttaattgcagctggtgctcggccattaatcgaattggatgacgttctagaagaagttttgtaaggaatattatatctaggcatgaaaggacgctatgtagaatttcatcgtctaggaagttatacttgtatatgtaaatattaaattttgaggtatatgcatgattacaatcaaagatgtggctaaagaagctggagtatcagtttcgacagcttctcgagcactaaataataatcctagaattagtgcaacaaccattgaaaaagttaagaaaattgctaaagaattagactataagcccaatgccagcgccaaaactttgtccctaggcaaagctaatgaaattggggtgatttacccagtaaccgctgacgaagatcctgctaatccgtttcatattgacttaatgcgaggaattaacacagcgttacaactcaaaaactttgttttatctgtcgcaatttgtcaaaccgaagaagcgttattaaacaatgtgaaaagaatggtggaacaaagccaaattcacgatttcttgttactatattccaaagcagatgatgtagtaaccaattatcttaggaagcaagagttaaactttgttattattggtgaaccgacgaatgaaaatgatcgttttattgataatgacaatattttagcggggcgcaaggtcactgaatttatgcttaaccaatataatgctaaacatccactttttctcagatctacttataattgggaatatgaaaaaaagcgtgagttaggatatcagcaagtgatgagcactaaaagtggttcaagccccttaatatataaacttgaaaaaaacgataataaagtagctatcgataaatatatgaaacaccattttgaaattgatgccattattggagcggatgatattgaattgctaagcttttatcatctattaaaagaaaatcagcatattaaaaacatccccgcgatttgttttaataatagtaggttaattagtctagccggccccaccgttaataaagttgatttaagaccacgggaactaggtaaaaaagcggttgaactactattcgattccgaattaagaaaagcgacagtcgggtttgatattatttaagaaaagaggaatacctctttttttattttgtcaaaaaagcaaacgcttgcacaatttaagtgcaaacgcttgcgcaatttaaatctctatgttaaattaataacatgaaagcgcttcataaaaattaaaaggggttgttatcattggcagataagacaagtgggaagggtcttccgacgcttccaaaaaatttgatttggatgattaattttggttttcttggtgttcaaactgcatttacattacagagttcccaaatgtcgcgtatttttcaaacgattggagcggatccaaacaacttagggtggtttttcattcttccacctttggcaggtttgattgtacagcctatcgtaggttactactccgatcgaacgtggaaaccacgtttaggtggtagaaggttaccttatctaattctaggaaccttaattgctgttattgtgatgctactgctaccgaattcaggtagttttggatttggttatggttcattaatggcactttggtttggggcgattacggtggcttttctagacctatcttccaacgttgctatgcaaccatttaagatgatgattggcgacatggtaaacgataaacaaaaaagttatgcttacgggattcaaagtttcttatctaatactggtgcagttttagcagctatttttcctttccttttaacttggctgggagttgccaacactgcgaataagggcgtcgttcctcaatcagttgttatttcattctatgcaggtgcaattttattaattataactagtttatttacagtatttagagtaaaagaatatgatccagcgacttatgcaatgtatcacggaattagcgaaaaagagaatagtgaaggtggcaattggattacgcttttaaagaaagctcctaaagcattttggaccgtcacgttagtacaattcttctgttggttcgcttttcaatacctctggacatattcagcaggtgcaattgctcaaaacgtttggcatactgctaatgcatcttcggccgcatatcaagcagctggtaactggtacggcgttttagcagcggttcaatcgattgcagcggtagcatgttcatacattttggctaaattacccaatcgattccacaaatcaggttacgcagttagtttaattcttggtgcgcttggttttgtatccgttttctttgttcataatcaatacattttaattgtttcttatatcctagttggaattgcttgggctggaatgaatacttacccattaaccatcgtaacaaatgctttatctggaaatcatatgggaacttacttaggattattcaacggttcaatttgtttaccacagattgtggcatccttacttagctttggcttattcccacttctcggtagctcacaagctaatatgttcctacttgctggtgcagtaatgcttttaggagcctttgccgtaggaacaatcaaagaaacttttgctgaataattaaacatagataaggagaacaatcatgattcgaacatttaatatagcaccttggcacattgaaactaaccagtgggatcccgaaaataaaagaattcaagaatcaatcaccagcctaggcaatgaaaatctgggtatgcgaggattttatgaagagggttattccggagacactttagaaggaatttatctcggaggagtttggtatccggataaaactcgcgttggttggtggaaaaacggttatccgaagtattttggtaaggtaatcaactcggtcaattttatgaaacttttaatcacggtaaacggtgaacaattagatttgaaccatcaagtaccgcaagactttagcctagacttagatatgcaaaaagctattttaactcggagttttagggttgaaattgatggcgtaaaactgaaatttatttttgaacgtttcgtgagtgccgcacttaaagaattagttggacaacgtctgacgattaaaaatttatctgatagcaatgctgatattgaagttattagtgctattgatgctgatgtttacaacgaagattcaaattacggtgaacaattttgggacgtacttgctaaaagtagtcagcaaaacgaagtgaaaatgcttgccaaaaccaaggaaaatgattttggcacggaacgctttacggtaggttttgatacgaccatcaagacggatatggactatgtcggtgatgtagaaaacgatcaatcgatcggtcaaaagtatcacatagctttacaacctgctacgactagcataatggagaaaagaaccatttttgtctcatctagagattttggtacagtcgatgaaataaacgaacagatgcaggaattaacgcatacgattaagacgcaaagtttcgagcaactgttagaacagcatgttcaagaatggaaacaaagatggcaaaaatcagacattgaaatcaatggtgatgcagaagcccaacagggaattcggtttaatttattccagctcttttctacctattatggtaacgatgcgcgcttaaatattggtcctaaaggttttactggtgaaaaatacggtggtgcaacctactgggatactgaagcatttgccgtaccggtatacctaggtgtatcggagtctaaggtcgttcgtaacttgttaaagtaccgttacaatcagctggatggcgcctttgtaaatgctagggaacaggggcttaaaggagctttatatcccatggtgacttttaatgggatagaatgccataacgaatgggaaatcactttcgaagaaattcatcgtaatggcgatattgcgtttgctatttacaactacacccgttatacaggtgatcagtcctacgtccttaacgaaggggctgaagttttaaccgaaattgctcgtttttgggctgatcgcgtccatttttcagcagaaaatggacaatatatgattgctggagtaactggtcctgatgaatatcaaaataacgttgataacaattggtataccaatttattggcgcggtggacactccgttataccttggaaattttggatcaaatcgaagaggacgttgccaaaaaagttaatgtatcgtcagtagaacggcaacactggcaagaaattatcgataatatgtatttaccagaagattctaagcgcggaatctttgtcgaaaatgatggtttcttaaataaggatttgaagccagttagttcattgccaaaggaacaattgccgctaaatcaaaattggtcttgggacaaaattttacgttcaccatatattaaacaaggggatgttcttcaaggaatttgggatttcattgacgatttttcaatggaagaaaaacagcggaattttgatttttatgaaccactaactgtgcatgaatctagtttatcggctgctattcactcggttcttgcggctgacttacacaaagaggctcaagccgttgagatgtatgaacgaaccgcccgcctagatttagataattataataatgatactgcggatggtctgcatattacgtccatgacgggtgggtggttagcgattgttcaaggttttgcaggaatgcgggttcgtaatgatcagctacattatgccccattcttaccgaaaaattggacatcttaccgatttagacaacaattccgcggaagagtaattgaagttagtgtcgataaaagtgcaacaaatcttaaattgattagtggtagcccactaagcgttgatttaaatggtaagaaagttgaattaagctgagtggaggaattaggaatgaaattttcagatataaagggattcgcttttgaccttgatggggttattgcagatactgcgaagtttcacagtcaggcttggcataatattgcagatcaaattaaagtgccttggacaccaacgttagcagcgagtcttaaaggagttagtcgcatggattcattggaattaatcctcgagtctggcaaccgtcaagccgactttagcttagctgaaaaacaagccttagctgaacaaaaaaataacgagtatcaacttttaatagctaaactaacacctaacgatattttacctggaattcaagcttttttagacgaattaagacagcatgattatcgtttggtactagcatcagcttctaaaaatgctcctggaattcttgaaaatctaaaagttacagagtattttgcagcaatcgtagaccctggcttgttgaaagcgggaaaacctgatcccgaaatttttgaaaaggctgctcaagcattacatttacctaccaatcatgtagcggggattgaagattcagcggctggcattcaatcaattaatgctgctggtgaactttcaattggaattggtgatttacccgaagctcagatccagtttgatactacaaatgaagttagcttagctggcattcgagcacaattagattaatggtttagaataagagatggcatttttttaggttaactaaaatgtcatctcttattttgagtaaagccctgtagaagctacgaaacgggtagtccatctttttaaattggggtataattagctggattctgacggttattagaaattttattaataattaagcggatttagtatcattattaccatcatttagggataaattcgattgaaattataactggattaatgactgttatttgacaatatcgaatattatgcaataacatggtgtctataaaattttaaatataacaaggcaaaggagcaacaaatgccagcagcgaaaaaaaaccttgtgattgtggaatcaccatccaaggctaaaaccattgaaaaatatttaggccgtacctataaagtagttgcgagtcttggacatattcgtgatttaccaaagagtaagatgggcgtggatctggaaaatgattacgaaccccattacatctctattcgtggtaagggcgatactattaaaaatttacgtaaagaagctaaaaaagctaaaaaagtttatctggcatctgatcccgatcgggaaggagaagccattgcgtggcacctttcatatctattagggttggatcccaaagatcaaaatcgagtggtttttaatgaaattactaaagatgccgttaaaaatgcattcaaaaccccgcgtagcattgatatgacgctcgttgatgctcaacaagctcgtcggattttggatcgtttagtcgggtattcgatttctccattactatggcaaaaagttaaaaaaggccttagtgctggtcgagttcaatcaattgccttaagtttaattattaaacgtgaacaagaaatcaaggcgtttgaacctgaagaatattggtcaattgattctgaatttaaaaaaggacgctctaaatttaaggctgccttttatggcgtgaataataaaaagatgaagctgcctaataacgataaggttcaggaagtattaaagaaaatcgaccctaaggctgattttgatattacggaagttaaacgccgagaacgcaaacgttatccagctccagcttttacaactagttctatgcaacaagaagcaaataagacgttgaattttagaactcgtaaaacgatgatggctgcccaacaactttatgagggaattaacattggtaaagaaggcaccgtcggtttgattacctatatgcgaaccgactcgactcgtatttctgaggttgctaagcacgaaacttctttatttattcatgatgagtttggcgcagaatatgctgctactaagcctcggaagggtaaaatgcccgagggcgctcaggatgcccatgaagcaatccgcccttcgtccgtattgcggactcctgaaagtattaaagaataccttaataaagatcaatttagactttataatttaatttggtcccgttttgttgctagtcaaatgacaccagaagtctcggataccatgacggttaagattgaacaaaatggagttcaattccgagctaacggatcaaagactaaatttgaaggtttcacaaaagtttataagaccaataaagacaaagataacgttcttccaaatctagaagagggcgaccaagtccaactggttaccaacaacccgaaccaacatttcactcagccaccagctcgctatagtgaagctactttaattaaagctttggaagaaaatggggtaggtcgtccttctacgtacgctccaaccttagacacgattcaaaggcgctactatgttaagttggagtctaaacattttgaacctactgaactgggtgaaatcgtcaatgaaattatttatgacttcttcccagatatcgttaatatcgattttacggctggcttggaaaaagacttggattcgattgaagaagacaaggaagactgggtgaaagtcgttgaccgttattacaaaccttttgctaaggaactagccaaagcacaggaacaaatcgaaaaagttcagattaaagacgaactagctggttttaattgtgaaatctgcggttcacccatggtagtcaaaatgggacgttacggtaagttcttcgcttgcagccgtttcccagactgtcgtaatacccaagcaattgttaaagaaattggcgtaacctgtcctaagtgtcatcagggacaaattattgaacgtaaatctaaacgcggtcgattgttctatggttgctctaggtatccggactgtgactttgtgtcatgggataaaccaattgctcgtgaatgtcctgtttgtcatagctacttgattgaaaagaaaattaaaggcggcaaacaaattgtttgtccaaatggtgactacgaagaaacacctcaaaaatagtttaaaaaacaaaatattaattgacgtttacctctaacatttgctacagtgacaagtgttggaggtttttttatggaattaatttcactgttcaaacagtatcttacggttgagcgtcaatattcagagaaaacggttactgcgtatctagaagatattgacgcattccaaaaatttttaactgacacgggtgataaaacggacctacttttagtagatcgtttcgatgtgaatgtttatatgagttatttattcgatcgacatttagctcgaacttcgatttcgcgaaaagtatctgctttgcgctctttttatcgttttttagttaagaatgatttagtggataagaatccgtttgaattagtccaactgaagaaacaatctgacaagctgccacatttcttttatgaaaaggaaatgaacatgctctttgaagcggtttaccaagcggaaggtgcccaaaagctacgtaatattgcgattttagaagtgctttatggtacggggatgcgagtaagtgaatgtgcagcgttacaatggtcagatattgacttttcaatgcaaactatcctagttctagggaagggaaataaagaacgttatgttcccttcgggcggtatgctaaagaagcgctccaaaattaccgaaaaaatgaatgggagccttttttgagtaaatataaacaaacccataattttgtttttattaaccattatgctaagccaattaccacaaccgggattgaatacattttgaaccaagtcattaccgccagcagcttaaatgggaaaattcatccccatatgctacgccacagctttgcaacggcgttattaaacaacggtgcagatttgcggactgttcaagaacttctgggtcattccagtttatcgactactcaaatctacacgcatgttactaaagaaaaactacaagagagctaccgaaaatattttccacgctcgactgatgcttaattaaaaaggagaatacaaatgccagtaaaatttgatgcgacaaccattattgcgattagtcataatggtgaaaatgccatggccggagatggccaagtaacaatgggtgaaaaatttattatgaaagggactgcccgcaaggttcgtcgaatttatgatggaaaggtcattgttggttttgccggaagtgttgctgacgcttttaaccttgaagaaaaatttgaaaagaagctttctgaatatagtgggaatttacaaagagcttctgttgaactagccaaaatttggcgtggtgatcaacaacttcaaaaattagaagctatgttaattgttatggacgaaaaagagatgtatcttgtttctggaagtggagaagttatcgctcctgatgacggaatcttagcgattggttcaggcggtaactttgcgctggccgcagctaaagccctcaagaagcatgctacgcaagtcagtgcaaaagaaatggctaaaactgcgattaacgttgcgggtgatattgatatctttacgaaccacaacgttattgcattggatttcaaggaggaagactaaatcatgcaggataatttaacaccacaagaaatcgttcaagaattagatcaatttgtaattggtcaaaaaagtgctaaacgcgcagtagcggtggcattacggaatcgttaccgtcgcttacaactttctggtgatatgcaagaagatattacacctaaaaatttattaatgattggacctaccggggtcggaaaaactgaaattgcacggcgtttagctaaaatcgttaatgctccttttgtaaaagtagaagccactaagtttactgaagtaggttacgtgggccgagatgttgaatcaatggtacgtgatctagtcgaaaatgcggtgcacatcgaagaagaaaactcttttaaagatgtacgagcagaagcttctaagaatgcggaccgtcgcattgtagaactcctcgttcctgttccaacggatactcaaaataaaaacaatgctgctgatattcaaaacatgatgaacatgcttaatcaattacagcaaggacgtacaccggataacttaaaccaaagttctcaaaaagtgccggatgatatcaaagaaaaacggatgaatgttgctagtaagttagctaagggtctcctagaaaatgatatggttaccattgaaatggacgatcctaagcaaaataacagtggcaatatgatgaaccaaatggggatcgacttaggtgaatctttgaatggcttaatgcctaagaaaaagattacaagaacggtagctgttcgagaagctcgtgaaattttaatccgcgaagaatctgacaagttggttaaccatggagacttgtatcacgctgctattcaacgagccgaaaatactggaattatctttattgatgaaattgataaaattaccggctctggtcaaaattcatctagtgatgtttctcgtcaaggagttcaacgagatattctaccaatcgttgaaggttcccaagtaagtacgaagtatggtttagtagacaccagtcatattctattcattggttcaggtgctttccatgaaagtaaacctagtgatttaatcgcagaactacaaggacgttttccgatccgcgttgaactaaacgacttaactaaagaagactttgttaagattctcactgaacctaagaatgcactagttaagcagtatattgcattgattggaactgataatgtgaagattacgttcacgatcgaagccattgaacgcattgcagctatcgctgaacaagtaaaccatgaaaccgaaaatattggtgctcgtcgtttgcataccattttggaacatcttctagaagatatcctttttgaaggtccttcaatggaaatgggcgaagtaacgattactgaaaagtatgtcgatgacaaaatcggtagcattgctcaaaataaagatctgagtgagtttatcttatagtaggaggatttcaaccgatgacggttactttaaaaaatgactatttaacagtcaaaattaacgaaaaaggggccgagttatccagtgttaaggctaatgatgggattgaatacatttggcaagccgcccctgcagtatggggccgacatgccccagtgttatttccctttgttggacgtctaaaggatgaccaattccaagtggaggatcaaacttatcctatgggtcaacatggatttgcgcgggatatggattttgaagcagttgaacaagatgatcaacacgtaattatggaattaaatagcgatgcagaaactcttcaaaaatttccatttgagtttaaactacgtttgcacttcacattaaaggatcatgaattgattgagcattacgaagtagttaatcctgattctaaaaaagatttattattttcgattggcgggcaccctggatttaatctaaatcttggagatacccaaattcagatggaagatactcatattcgaatcgcgcctaaacaagtgtataatcaaattccacttaaggcaccttacacggatcctaaaaaccctatcaagtttgatgctacaactccgcttgatttaacgcatgcgctctttaaagatgacgccatcatcttggaccttaagggagaacaaatcaccttaatgaccgaaaatgaagtgaataatcacggtattgcgtttacggttgctaacgctccataccttggtatttggtcaccatatccagccactgctaattttgtttgtttagaaccgtggtggggaattgctgatactgtcgatttcaatggtgaattaaaagataagcttggtgtaaatcgtttagctgcacaagaaacatttaatcaagaattttcaatgtcattcttctaaaaagaaaacccctaaagggtcaggttcgcgagttagtaaggcgaaacctaatcttttaggggttttgtatgtaattcaaaccgcagctacttatttttctttcgataatagagtccaaatggaactaaattttcatttccagccagaatacgttggatatttgtgcgatgacgatatatgataaaggtcgtcaatgctaccgctacgatggttaaaatccaatcgtggtaaaaaagagagataataaccagtagtggagaggacacgatgctcgaaaaactaaccatgctggatacgtaaatgaagaaaataaaaagacagcaggcaattaaaaaataactaggattataggctagcaacattccagcacttgtagctaccgcttttccgccacgaaaatgatcgaaaacggaaaaagtatgacctaagatagctcctaaaccaataattaaaggattaattccctgtacgtggaagacaatcggttgcagagtggcgagcgttccttttaaaagatccatgcacaacaccaaaacgccagcctttacgcctagaacgcggaaggtattagtggtcccagtgttaccacttccttcttggtgtaaatctttattaaaatgtttggcaaccagtactccagaagggatggagcctaggagataagctacaagtagcatgataataatttctatcatgttctttcctcttttctataaaaaatcctgcatattttatacatttgacttaattgtaataaattacagtaacaatgcagtattataacatttatcgaaatgttttcatcagtttaaaaataagttatgataatagtactgaccttaaaggagtaacatgaatggcaaaaacaagtaaaacatcgtatgatgattcatccatccaggtcttagaaggacttgaagcagttcggaagcgtcctggtatgtatattggttcgaccgatggccgtggactacatcatttagtttacgaaatcgtcgataacgccgtagatgaagctctcggtggatatggaaaagaaattaacgtaacaatccaagcagataacagcattactgtggtcgatcacgggcgcggaatgccggtagggatgcataaatctggcaaacctacacctgaagtcatttttaccgttttacatgcaggtggaaaatttggacagggtggttataagacatccggtgggcttcatggtgtgggtgctagtgttgttaatgctctatctgaaaaattaaccgttgagattgtgcgagacaaagttaaatatgaagaaactttcgttaacggggggcacccagttggaaccctaaaaaaagttggtaaaacaactaacaaaaacggtacaactgtcacattcaaacctgacaaagaaatctttacaacaactgtgtttaacttcaatacgttagcagtacgattacgcgaatcggcgttcttactccgtggggttaaaattactttaacggatcggcgtgaaggacacgaacaacacgaagaatacctttacgatgagggaattaagcaattcgttgactatcttaatgaagataaagatacccttggtaatatcatgtatttcgatggtacaaaaaagggaatcgaagtagaagtggctggtcagtacaatgatggctattctgaaacgatcctctcctttgtgaataatgtacgtactcgtgatggcgggacccatgaggtcgggatgcgttccggttggaccaaagccttcaatgaatttgcccgtaaaatgggactgttaaaagaaaaagataaaaatttagaaggctcggatgtgcgagaaggtttgtctgcagttatttcagttcgcatcccagaagaattattggaattcgaaggccaaaccaaagaaaaattaggtactcctgaagctcgtccgattgtggatgccattgttagtgagcaactgggctttttcttgatggaaaatggtgaatttgcccaacagttagttcgtaaagcgattaatgctcgtgaggcccgagtagcggcacgaaaagctcgtgatgagtcgcggaccggaaaacggaaaaagaaacaagaacgtattttatctggtaaattaactccagcacaatctaaaaactctaagaaaaatgaattattcttagtcgaaggtgattctgctggtggtagtgctaaacagggacgaaaccgtaaattccaagccatcttgccattacggggaaaggttttgaatacagaaaaggctaagctacaagatatcgttaaaaatgaagaaattaataccatcatttatactattggagctggagttggaacggaattcaatgtccaagatagtaactacgataaagtaatcattatgaccgatgccgatactgatggagctcatattcaaacgttgcttttaactttcttctataaatatatgcggccaatgattgatgccggaaaaatttacatcgccttgccaccgctttataagttacaaaaaggactcaataagaaggttaaaattgcatacgcttggacagatgaagaactcgaaagtgtcagcaaacagatgggtcgaggattctccctccaacgttttaagggacttggtgaaatgaatgcagaccaactctgggaaactacgatgaatcccgaaactagaaccttagtccgagttcgtattgatgatgacactttagctgaacgtcgggtaaccaccctgatgggcgataaagttgaacctcgccggaaatggattgaaagcaacgtggctttcacgcttgaagaggatggtagtatcctagacaacgaagctgtgaaacatgagcatgaagctggagatccaaccaatacttcaaatgaaacttttgaagaaattaaacttgatatagaaaacaattagaaggggaatatgaatggctgataatcaatctaaaattcaagaactggctcttgaagatattatgggcgatcgttttggacgatattcaaaatatatcattcaagaacgggctctgcctgacgtccgagatgggttaaaacccgttcagcgtcgaatcctctttgcaatgaataaagacggtaacacgcatgataaagcttttagaaaatcggcaaaatcagtcggtaatgtaatgggtaattttcacccccacggtgatagttcaatttacgaagctttagttcggatgagtcaggactggaaactacgagttccattaattgaaatgcatgggaataatggatcaattgataatgatcctcctgctgcaatgcgttatacggaagcgcgtttaagtgaagctgctgaagagatgctaaatgacattgataaagagaccgttgatatggtcttaaatttcgatgatacagagtatgaaccaaccgttttaccagcacgttttcctaacctcctagttaacggagcaaccggaatttcagcgggttacgctactgaaattccaccacataatctgggtgaagttattgacgcagtcctttatacaatcaaacaccctaatccttctttagaaaaattaatggaatttgtgaagggacctgattttccaactggagggattatccaaggaattaatggattgaagcaagcttaccgtaccggaaaaggacgagtagtagtgcggtctaagacttccgttgaagaaattcgtggtaataaaaaacaaatcattgtttctgaaattccctatgaagttaacaaagctttgttagttaaaaaaatcgatgaaatccgcgttatgaaaaaagtcgatggaattgctgaaattcgtgatgaatctgaccgtgatggactctcaattgccattgaactaaagaaagatgtcgacgctcgtggaattctaaattacttgtttaagaatactgatttacaggtttcttataacttcaacatggtagcgattaataaactaagacctgaacgcatgggactcaaagaaattattcaagcatatgttgatttccaaaaggaagtcattaccaaacgaacaaaattcaacttgaagaaggctgaagaccgtttgcacattgttgctggtttaattaaagctctttcgattttggatcaagttattaaaactattcgaggtagtaaagataagaaggatgctaagcaaaacttgattactagttttaacttttctgaacgacaggcagaagccatcgtgtccttgcaactttaccgcttaaccaataccgatgtaacggagcttaaaagtgaagctaaggcacttaatgattcaatcgatgagttcaataacattcttaataaccctaatgaattatcaaaagtcttgtcggcagaattacgtcaagttaaaaaacgatatgccacgccacgtttatctgaaattcaggaacatattgaagagttagtggttgaccgaaccattacagtaccagaagaacaagttatggttttagttagtcaatcgggttatttgaaacgtagtagtttacgttcctacaaggcttccgccgaagaggatggtctcaaggagggcgattttaccgtcttcaaaaaggaactaaatactttggatcatctaatcatgttaactaataaaggaaatctgatttatcgtccggtacatgaaatcatggaaacccgctggaaggatactggagagcatatttctcaagcaatcggattagcagatgatgaaataattctaaaggcctttgacgttaagaacttcgatgaaccagtgtcattcttgatcgccacaagtgatggttacattaagcgcacgagtctcaaagatttcaaaccaggacgtacgtatcgtaaaaaagccgccgtttatattaaattaaaagcagctgatgctaaagtggtcaatgtggctaagctaaccaggcaatcgactaaagaaaccattcttttggccactcgtaatggttatggattacggtatgatttaattgaagttccagaagttggtcctcgcgcagccggtgttaaatcgatggatcttcgtgaagatgaaatcgctaattttgtactagtaaacgatcatgatcagattggtttaattactaatcgaggttcgtttaagaagatgaaggttagtgaaattagtgtgactagccgtgctcgccgcggtgttcaaattctaagagaacttaaaaaagaaccacatcgagttgcagatattgaagtggtcgaatcaggtgaagcttttgaagtccgaacttcacgaggattaattcatgatattattccactagagcatccactaaatgaacgttactccaatggaagctttttggtcgatgtagattcagaaggtgtaccagtatcgatgaatttaaaggaattagattctgaaattttaaataataaataaattaagcagattattacttgccctttatgaatactaatattagacttattattggagattgttagttcgtttaggctaactgaaaggagtgctctagtatgcagacaaaaacagaaaagattttttcatctaaaactttgtcatattttttaagactcacggatacgatgagctacacacaaagcgcccaacttttaggaattacacagcccgccttaacacagcagattaaaaaacttgaacatgccgtaggtgtgccattattctacaccctcggcaaaaaacttcgtttaactgacgctggatacacaatgttgaatgctacgcatgaaatcaatcgtattttgaaccatgcgactgatgagattcaacaagcaacaagtagcggacgtggtgatatttcggttgggattttagcttcgcttgaaactcgtatttttgaagattttatcgctaactattacaataatgtccctgaaattaatgtaactgttcatatgctcacgcgttttgaaatttgggaaggtttagaaagtaaccgattagactttgcaattacatatcttccggatgctaatatccgtagttggaagccttaccgagcacgtaagattggaacagaacgtttagtttttgttcatcatgatgaacgtttgtcaaaagcacggggcgtaagtttaaaacgtgcagcagcttttgattgggtatcttatccagaaggttattatttggatgaccttattacagaagtatttaaggatgcgatggtaactaaacctaagagtgttgcttactttacaacccccgctcaaattttgagtttttcgaatagcacggggatcgctacggcattaccggaatcttttgtggtagcccatcaagacgaagcaactgatgcttatataactaagtttgaccctaagattagctatgaaattgggtttgtttacagaaaagacaaagacaaaattccacggatgaacgcctttttgagtgccttctttgaatatatggacggcgagaagtatattgataaggtacgtaacctaactacaaaaaaagatgattaaaggagactttttataatgaataaacaacttgttttcggacattctaatccagatacagacgcaatcgttgctgcgaaggcctttgcatatttacaaaatcaattgggagtagcagatgcagaagccgttgctttaggcaatcctaaccctgaaacagcttttgttttatcacactttgatgaagcaactccacgagtaatcgaaacagctgccaacgaagtagattcagttatgcttgttgaccataatgaaagccaacaaagtgtttcagatcttaatcaagtaacagttactgcagtcgttgatcatcatcggattgctaactttgaaacttcacaacctttgttctaccgtgctgaaccagtaggttgtacaagtacaattttaactaaattattccatgaaaataatgttgaaattcctgctaaattagctggattgatgctttcagccattgtttctgatacgctactccttaagtcaccaactacaactgatgatgaccgtaaagcccttgaagaactagctaaaattgctaatatcgacgtagaaacttacggtttagaaatgcttaaggccggaacggacctttctagcaagtctgaattagaattggttgacggtgacgctaagagctttgatatgggtggaaagacaatccgtattggtcaagtgaacacagttgatctcgatgacgtatttagccgtgaaactgcactagttaagacaatggaagaagaaaaccaaaagaacggctatgacatgttcttattacttgcaactaacattctttcaagtgattcacgcttactagtagttggtgaaccaaaggatatcgttgaaaaagcatttaacactgaattatcagatcacaacacagcagaccttcctggcgttgtatcacgtaaaaaacaagttgtacctcctttaatggatgcatttgcataagacgaatactaaaacagatggcttaaggtcatctgttttttgtttccactgaaataggattagatatactaaaagtcataacctaggagtaaatatataatatgaaatttgttattgcaccagattcatttaagggtggattaactgccaaacaagcagccatcgcaatccaaaatggtattgctcgggtttatccgaaggctgattacacgttagtccctatggcagatgggggagaaggaaccgtgcaagcactggttgatgctactaatggaaaattaattaccgaaaaagtgactagtccattaggagatccagtagaagctacatttggtatcttaggtgatcataaaaccgcggtaattgagatgtcccaatcaagtggtattcaatttattaatcaaaatacacaaaatcctttaataactacaacctatggaaccggagaattaattttaaaggctttagattatcatatttcaaagctgattattggaatcggaggaagtgccactaatgatggaggggctggaatggctcaagccatcggggtccatttattggataataagcatcatgaaattggtcgtggaggtgaagcactaaagcatttagctcaaattgacatgactgacattgatccgcgtttagctaaagtccaatttttaatcgcttcagacgtgacgaatcctttagttggtccaaagggagcatccgtagtttttggaccccaaaaaggcgcgacgccggcaatgatccgaattttagatgaaagtctcacgcattatgctgaaattattaaacgcgatttaaatcaagacttagctaattatcctggagcaggtgcagctggggggctaggtgcgggcttactagcttttaccaacgcatctatcaaaaagggaattgatattgttacagaatatagcggacttaaggaacaagctcaaggagctgattttgtttttaccggtgaaggtggtgttgattatcaaacgaagtttggtaaaacgccttatggagtggcattggcaactaaatctgttgctgcaagcgctccagtaattgtaatcactggtaatattggtgaaggtatcgatgaattgtattcagataaagcaatcgatgcggtgttttcaagtgtgtcaggtgttaaaactttagagcaagcattgatcgatgctccgcatgatattgcccaagttgctgagaatattgcccgattaattaataagttttaacttaagcttttattttgtaagcatcttaatcccctaaaagacatgaatgttttataatcgatgttataggtaagggggaatttaaatgaattcaaataactggtccaaagcagagctaaaaaagaaactgtctcctgaagaatatgaggttacacaaaatgctgctactgaacatcctttcgccggtaaatacgataatttttaccaaaaggggatttacgttgatgtcgtcagtggtgagccactttttagttccaccgataaatatgacgctcactgtggttggccttcttttaccaagcctattgaccctaaattagtggttaatcatcgagattcttcttatggcatggaacgagtggaagtccgcagcaaggatgctaactctcacttaggacacgtatttgatgatgggcctctcgatcaaggtggaaatcgttattgtatcaattcggctgccctgaaattcattgcatatgacgatttagaagcgcataatctaggttatttaaagaaactatttaattaggagcgtgatttacttatggaagaaactgctatttttgccggtgggtgtttttggtgcatggtagaaccttttgaaactcaacctggtattatcaacgttgtttcaggttatacaggagggcatgtcgccaacccgacctatgaacaagttactagtcatactactggacatacagaagctgttaaaatcacgtatgatccggaaattatttcgtatcgccaattagttcaaatctactggcaacaaactgatccaactgatgcaatggggcagttccaggaccgtggcgataattaccgaccagtaatttttgtgaatagtgctgaacagcgtgaaattgctgaaaaatctagggaacaattagccaaatctgaaatgtttgatgaccctattgttactaaaattgaagatgctcaaccattttatccagctgaagaagaacaccaagaattttataagaaaaatccccttcgttaccaaattcaagaagcgggtggacgatcagaatttcagaaaaaatattggaaataaaaaagatgagagttcattttaaatgaactctcatcttttagtttttaattaaatatttttatttttttctcttctaaccaagaagatccaagcgatgatagcaaagaatacaggaccagcaactgtccagaaacctgtgaacaaatcaccagaaatgaatggtgagatagcagtaaataccacaccaattccgacagttagaagtacaactgtaacaatcgttaacatccaaggacgactacgataaacttcgaaaggtcgatcaagtccttctttagccttgaagaatggaaaggcaccaactaagaataagtaaggtaaagttgtagatacgttactcattgaagtaagtacgttgtagaagaaagtagcttctttgtgagtaattgaagctaaaattgaaatacctgcgataaatacaataacaacgatagcttgtagccacattgaattggcaggcataccattcttgtttaactcagtcatcttctttggccatagttctttaggagaacccatgataaaggacttcaatggtgagtaactaagaacgaagaatgaaccaacataagcaaataacatcccaacacccgcaaatcttgagaaggtagttcccatgattgcagcagcagctgggctcatacccatggctttacctaattccaaaccaaggttttgcatcatcacataagtaatgttacccaggttagctttttgagcaagaataactgtgttccagttagcagaaacgccccaaaggaagattgctaaagaataacccacggcgataaccacaccaccgatcataattcctttagggaaagttttttctggcttatccaaactatcagtaacaccaccaatggattccaaaccaccataagcaaagattgcatagataacaaatgaaattaaagcgattggtgattggaactgtgcgctaggcgaagtagcaaaatcactcaaatggtgaataggttgggcaaggtgaccatggttagcgattaaaatgaaggcacttgcgagaagcaagataacattcataaccattacagcaataccaccaagggaagacactttagccaaagtattgattccacgagttgttgcccaagtaacaaacaccatccatagaatggcaagcagtccaactgttaaagttgagttaagtccaagaaatgaccaactaccagttgtgtcatgaccagaaatgattgtggctagtgtaatccaaatcttttgagcaatcataaccatccagattagccatgaagctaaccacatgaaggttgcgataaaggcccatttttcaccaattgaaccttctaaccaagaataaatcccaccttttgcttccttgaaagtggaaccatattcagcaaacatcaaacctgctggaataaagaataaaatagcaccgacaatgtaccaaaagatagctccgtaacccatttgttggaaggctgttggagtattaccaaaaccaaaaatggttgtaaaaatcatcaaaactaaagcgccaagcgatagttttttcttttgttcacccatagtgaatctacccctaactatatttatgaataaaaacaaattacatatgaataatattatagcagaagtataggtaaatcatttacgtatcattaaaatctaattgtacttaaatcataatttaattatatagggtgtttgccttgataagttactgtttatttaatcacaaagtagtatttcctggataaatttttaaaattatataagctaatttttaattagttatttttttaatctaactccaaaatgtatttattcattattttatgaatataataaggaaaatgaatattttaaatgataaataatacttaatttctgtaattaatatagaatgttttttcagtgaaagtataagaaagaattcaacattcatcaatacatctctttatagaaatttggtaaatatctttgtatgagtaacagtcatcaaagataaaggcactttttcaaaaaaagtcccttacaacgtaccagaattaacgggcttggttagggactaaattacttcagttataattattaatatttctttagttcgtctttgtcacgcaagtgaatattttgtttattgtcttctatcacttcgataaccattggttcagttgtcctataagcctcaattagggccgcgtccaatgcttctttcgaatgaacccgacttgctttgataccatagctttcggccatttctttgtaaccgatgtagtcgatatcaacgccttcttcttgtccttggtaatctagttcttgttggaattcaaccatattatattccttatcaacccatattacttgaacaatatttaatttatagtgtgcaactgttgccaattcttgtgatgagaacataaagctcccatcgccaccagaagacaaaatcttttcatttgggcgaaggaatgcagcagaaattgcccatggaagacctacgccaagcgtttgctgaccatcagacatcaaaaaatgtttcggccgataaacatttaagtaagaccccatccaaacttcgtggctaccaccgtccatcacaacagttgtatctggatgtttatcaataactttttgtaacgaactaacaatttctaatgggtgcaacgaatcactagaaattgttttaggaacttgttttttcatcagtaatttttcttgtaatgtatgaacagtagacttccattcatctgtgatgttttgttcagaaattattttggtgatgttttttaaatttttagcaatgttaccaagtactaatgtatctgggataaaagtttcatctaagtgatctaccactgtatcaatgtcaaccacagttttcttgtcagaattccatactgaagcccaatattcaactaaatttaaacctaaagtaattactaagtcactattatagactaattcatcaccaggcaaattgttaaacaaaccaacacggccgacatagttttcattaaactcatgagtcaataaacctgttgcctcaaaggtttcaaccactggaataccagtttttcttacgaaagcttggattgccttggcagccgattcatccatcgcacgagcgccgacaataattacagggcgttttgcttgtttgattttacctactgtatcagaaatagttttttcatcactaatcgtattagctaattgatctgcaatagccgtaaattcaagtccttctttttcggtttcagcgagcaatacattaccaggaacatccataaataccgcgccaggattgccattgatacttgtaatatatgcattcgctacttcatcagcaagagcacctgtatcttcaatttcttttgcatattttgttacagttgaatcattcatcacgcctgaaatgttagggttctgtgggtaaggcgttaacaatttggcttgcggtacttgaccagaaatcgctagaacaggatcgccgtcagaggttgctgtggctaatggagtcacaagattcaaagctccaggaccagaggttgtcatcacaacgccaggtcgaccagtaatacgaccaattccttgtgccataaaacctgcattttgttcatgtcttaccgttacaacttcaatttctttttcacgcttctttaaagccattaataagggaccaagtttaccaccaggtaattggaagacatatttaacaccgttctttatcaacgtgtctacgattaaatctgcaccgttcatactcataataaatacctcctataaaaaaataacgttaagattcatcaatggaaatagattacccccccttgttaaagaagtaaattagggaaattatttatacttccggatctacatcttctttaattcagaatcccacatttcctttaaatttaattgttcatatttattaacaaaatttaccgctaacttttgcaacttgatgcaagtgatgacaaaacaaaggttgtattttatccaaatcctaacctcgaagtattaaaaaattttacctccttggttaggttatgaataaaaagtttactttttgtaagtaagagactaatataattccatatctatcatggaggcgaaattacttgataagaaaaatatacaactgtaaaaaaggttgttcggtggaatcaacattgcaaattatctctggacgctggaaaagtgttctattgtaccatttaatctttgatggtgaattacgatatagtgagcttcaaaggacgatcccgggaattacgcgccgaatgctttcccttcagttaaaagacttagaagcagataaactggttgaacgagaggttattcaggaaaaaaattaaaggtggtttatcgagtcactgactatggttactcactaagaccagtcattgaaatgctgtacaactggggagaaaactacaaccaacgctatgccggaaaattaaaagaagaatttttaggaggatcttagttaaggaccttgcaagtaagtattcaatttcgtccaatctttcttacttacctttgagagacagagcttgatggccagcgacaccaataaattgtacgaacaattgaatttaagggaatcatgggattttgaattagagcgggtgtagaatccggaagtataaataatttccctaatttacttctttaacaaggggggttaatctatttccattgatgaatcttaacgttattttttataggagatgtacaatgaataatccatttttaggtttgcaaaatgtgccatcctttgatgtcacaagtaaagacattgttaatggtagactttcagatataaaatttatgtctggtgattttggcatcgaaggtggacaagacatttcaccggaagttagctggacaggaacaccaagtgatacaaaaagttttgttgtcactttgtatgattcagatgctccaactggttcaggtttctggcattgggctgtttataacattttagctacagtaaacaaattaccacaagatgctggcaacaaggataattcaaaattaccttcgaaggcaattcaattaccaaatgacgcacgaacaaaaaaatatatcggagccgctcctcctaaaggacatggggtgcatcactatttcttaactgtttgggcattaaatgtagaaacagttgctattccagaagattctaccccagcttttttaggatttactatgtttggtcatgtattggcccgcggagtattgaatttcgaggtagaagtaaaataatctttatctgaatcagaaaggaagacatatgatgaattatcctacagaaaatttttttggtgaattagaacaagtgcatgctttttatgatgaaatgccaacaggtgtcagtgtgacagaaacaggtcgtattttcattaactttcctgaatggggcgatggtgtaaaagcaactgttactgaagttgtggatggtgaactagttgcttatcctagccaagaacttaacacttttgaccctaaaaatcctgagaaaaattttttaagcgttcaaagtatcgttgctgacggcgaaggaactctatgggtattagacactgctgcgccgaactttgatgttcctgttaaaggcggagcaaaattagttgcgattgatttagaaagcaatactatccggaaaatctatacttttgccaatgatgttgttctaaattctacttatttaaatgatgtacggattgacttgcgtcgaggatcagaaggggtagcttatatcactgattcttccattacaggaccaggtgcgttgatcgtcgttgatcttggaactggcgattccttccgaattttagatggcgcccgttctacagccgttgattctgatttcgttcctaaagtagagggcaaaatcttgatgaatcgggaagcagatggttcaacttctccgtggcaagtggcagctgacggaattgcaatttcaccagatggtaaaacattgtacttcagtccattatcaagccgtcacctttattctattaataccgatttgattttcgataaagatattgaagatgaagaacttgaaaaacatgtcaaagactggggagaaaagggggcttcagatggtatgattactgtagcagacggtacaattttcgctggtgacttcgaaaataatagtattcgtatcattaatactgatggttcattcgaaacattggctcatgatcctcgtattttatggcctgatactttgtcaattggtccagatgaatacttatactttaatactaaccaattgcaacgccaaccaagtttccataaaggtaaagacttacgtgaaaaaccttatagcttatttcgtatttttattggtaaaggtccagctaaagtaaaataatatcattaaatgtaacagttctcggatttctacgttatctttattgtcggtagttgcaatttgtgcaactcttagtctcaatacctaaaagtaaggtttcgaagtctttatttaaatctttaacataagataattaattaacgaaatacccgagcgataagatgatttgattacgcttttgaaaggtccttctctaaaaatgcgttactttgaaattttcatcaactatagttcagatatctttatatactttttgcaaaatccaatagttttaaaagggagaaaaaatgactgatcaaactgaattacgtaaagaaatactatatgttcacaagcaccgctttgcgacaaaatcttttaatccgaccaagaaaattgccgaggaagattggatgacgattatggaagcagctcggttgtcgccaagttcttttggttatgagccttggaaatttttattagtgaaaaaccaacaaataaaagatgatctacaagatattgcttggggagcacgaaatagtttatatggagctagtcattttttaattgtgctagcacgcaaaaacttaaccggtaatagccctcatgttaaacatatggtggaagatgtattcggtgttccttactctgaaacatcgcctcaaacgatattttttaataactttcaaaaaaacgactttggtttaactgatgaacgttcattgttcgactgggcctcaaaacaaacctacattcctttagctaacatgctaacaactgcggcctacttaggaattgacagtgtgccaattgaaggttttaataaagaatcggttgaaaactatttagaaaagaaaaaaatcatcaatttggatgagtttggcgtttcttatatggctggctttggttatcgggaccaagaaatacctgaaaagaagcgtcaaagcctatctgatatttatgatgtgattaaataaaagatgcaattcgtaaaaagataaataaaatcaaggaggagttcacatgttagaaaaggagtttatgcatgcagttggattttttgaaggattgccaattaatgaagaaagaagttttattgacgaaaaaaagatagtaccgaatcttgaatctagagatgttctagtaaaagtaaaggcagtatctgtgaatccgatcgatactaaattgcgtaaagatagtattaaaagaaatgcgcttcgagttttaggcttcgatgcagttggtgaggtagtcgataccggaaaagaagtcgagaagtttaaaattggcgatcgcgtcttttatgcagggacaactactcgtgccggtagcaaccaagaatatcaagccgttgatgaacgcattgttgctttagcacccaaaaaactatcggatgaaggagctgcagctttgccactaacctctttgacagcatatgaactgctttttgaaaaatttggtttaacccccgaagaaggtgctaacaaaggcaaaaaaatcttagtcattaacggagcaggtggcgttggctcagttttgaaccaattagcacactgggctgggttagaaatttatgcaaccgcgagtcctgaaaacttcgaatggttagaaaaattaggtgtagatcaccctattgattatcatgatgatttaaaggatgaattaggggtccaaaaagtagactatattgctgttttattcgatatcactcattacttgggtcagattaaacatatgattaatccatttggtcatgtcgggactatcgtaggaattcatgacgcgcttgatatcagcgattggaaaaatttgtcggttagctttgattgggaatacatgtttgcgaaaaccgattacaattatcaaattgaaactcaaggacaagctttaaaagtaattgctagattggcggacgaaggtcaactaacgacaacattaagtaaagtttattccgatggcatcaatgccgttaatttgaagaaagcaacaaaagatgttgaaacgggacatatgctaggcaaagtagttattagcggcccatttaatgctagtaaataaatacattaaaaatagcaattcattttaacagacgtaaaatgaattgctattttttgggagaagtataagaatgaataaaagtgattttaatatttaaaataaatactattttatattattcgatttattataaactttgtataatatatattatgtaaactagaataagaaaaatacaaagtaaccattcttatatctctcctcctcttattttttaattattaccaacatatttttatatgctaccagttataatgttagctagaatactaactatatttttattgcggctacaatttataaatttagtaattaacatttaggtagctttatatcttatttatcaaaaaagccttcttaaaccagtttttaaatctggtttaagaaggcttttattttggattaaccaaacaaatattgaattacagtacctaaaatagtagtaacagcaaaaactaaaacaaatagcattatagacttaggtttaacattctttttatttcttttgctaataagtgtaaaatcaagtagtccgattgtgataatttctagaataaattgaatccagactagcaatggtgacattgcaactgtatgaacaacattcactaatcccgttataataagtacgatatccaatattcttgcacaatactgtgcaatcagtgtttggtgaaattgatcaattgtaattccatatgtacaaattaatccaattaaaatccataatataacatgtacaaacattaatgttgacattaaagtagctccttttaatttagactgctaaaaacagtttagcataactgcaaacactatattaacgtcacttcctaaatgtaataatactgaaatcttaaacaagataattatggataacttattaaatttagatggaaaatcaaaaattaaattagaaaggctgataaccattgttaaatagatcattaagcgttgcaatttttggcgcgattggaggaatcttacggtatctactccagttatattttgatgctcgattcccctcttttccattatcactaattcttattaatgttcttggagccttgctcctaggaatactaacaggcgggctattaaccttgttagatacctcagatactattaacgtaggattaactacgggattgatgggtggcttcacgaccttctccacttttgaattagcactattaaatcaacttactgtagcacattttaggacgatgattatttttttgcttacatccgttattctatccttaattttagccaatttcggacaatttctgggtggtaaactactcaaacattatcgaaaggattggtgatatttcatgattctagtttatgttggtatgggtacggcccttggtgctgttgctcgtctttttataactacgcacttaaaccaaacatttaaaaaacacgcctttccttggtcaacttttattgtaaatatgattgcttgttttttgattggcttcttaaccgttactattcacgattctaagcttaaattgttattaataagtggttttctcggagggctttcgacgttctctacctttgctaacgaaatagtcactctaggacaagataagacaacaaaaaaacttgcactactttacagttgtgcaagtttaggatttggaatcatacttgtttatctaggaatgcagatttatgcctttgtataatcaattacccaaattagagcgatcgctttttcacccaaatgggttccaatcacaggaccaaaataagaaatatcaattggcaattgaggatatttttcctctaagctagccttccatttcaaggctgatttttcatcattaccatgaataacaaatgcccgtagaggatactcagccgagcggtaagcttcatcaaaaagtttttcaacgcgggcaatcgcttttttacgagaacgtactttttcaaaggccacaatttcatgcgcatcattaaaagttagaattggtttgattttcaataaacttccaacaaaagcagaagcattagaaagtcgaccaccacgaacgagattttgtaaatcatcaacaacaaaatattctccgaaggtcgaacggacatagtccaaacgttctaaaatggtatcaacatcttttccttcacgagctaatctagcagcctctaaggctagaattcccattaagcgaatagtgatttgtgaatcataaacaaccagattaacgccttcgatggtaccctcaagactctttagacttgaaacgaagcctgaaatcgtgctggccagatgaatactgataatcgtatcgtatccagccttagctaaattctcatataattcaatcatttcacccaatggtggttgagaagtacttggaaaggattgagaagtccgtaaacgttcataaaactcctctgtagtaatatcaacgccttctttatagattttgccgtcgataattactggtattggtacaacggttatattgttgtctgcaatttcttgatcagttaaataacaagtactatcagtaacaatagctgttttcattagtacacccacttcattttaaatcaataacaaatactataacataaatcagtctcaatttctcgtctataacggactaattactactattttaaggcatttttcaaaactcgattaatcaaaatattgaacatcgacaactcttcttttgaccaattttcaaatagtttttgatcataaatatctaattggcgattaacctcatcttttaaaagacgacctttttcggtaattttaaacagcgttcgacgatgatccgcttcaattttatttcgagatattaattttttctctacggcacgctttacttggcgactgagtgtcgagatatctaaaccacttttatcaacaaaatcttgaaccgacaatagatcatcttttaaaaaattggtaattttccagtctgcaatcgtcccaccattttccatacaagtgctcttcaaaaagttatatctttgtcgattgatgacctctaaagcctctaaattaccaatcattttaataacactcctttaatcaaacctatatttgtattatacaacaaaaatacttgtatggtacaaatataagtatttttgcaacaaatattttttaacgttatacttaggtatctcactttaatatagaatggactgataaaatatggcttttgatggattatttacctatgccatggtaaaagaattagtgaatacactaaaaactggtcgggtagctaaaatctaccaaccttatcaaggcgaacttgttcttacgattcgagtgaatcgtaagaacaaagcattattattatcttctcaccctaattacgccagagcgcaaattacggaacaaaccttaaccaacccttctacgcctagtaactttgttatgagtcttagaaaacatcttgatggcgctattctaaaggacatcacacaagttgaaaatgatcgaatcattaatcttcattttgctcaccgtaacgatattggtgatgaagaagatttgattttatccgttgaaattatgggacgacgaagcaatattgttctccactcgtcaacaactggcaagattattgacacgattaaacatatttcttctgatcaaaatcgttatcgaatgttggtaccaggagcccattatctgactccaccagcccaagatttactcaacccttttgtagctgacgctgaaaagatgatggaattacaaaataaataccctaattatgaggtacttgcacaagctattcgaacaaccttccagggctttggtaaggaaacagccttagaactcgcctatgagatggttaacgctaaagattccttaaaaaccattcaggattacttagccaagtttgaccaacctactggttttatttatgataacaaagccggaaagcttacttttgcagccgttaaacctcaattagatgttaacgaaaatgacgttcaccaatatgctagtctttcagaaacattagatcattattattatgaaaaggttcaacgcgatcgtgttcaacaacgtgggcacgttttaattcgagtagttcgtaatgagctgaaaaagaatcggaaaaagctaaaaaaattacaacaaactatgaatcaaaccaagcttgcagatacttatcgtgttaaaggtgaaattctaacaacctatttacaccagattgaacgaggtatgactgagattgagttacctaacttctatgatgaaaataagttaattaaaatcggtttatcaaatcaattgtccccttccaaaaacgctcaaaaatactttacgaagtatcaaaaagagaagaatgcagtgaagtacgtttctgagcaaattgctaaaactgaaagtgaaattaatttcttagataacattgaaactcaaattgacttagccaagccggaagacttagatgatattaaattagaattggaaaatgaaggttaccttaaaaagcaagttaaccctaaaaaacggattaaaccaactaagagtaagccggaacgatttgaagctagtgaccatacaaccattctagtcggtaaaaatgatactcaaaatgatcggttaaccatgaagacggctaaaaaagatttctactggttacatgcaaaagatattccaggttctcacgtaatcattgaaagtaatcaaccttcagaaaaaaccatcgaggaagctgccacaatcgcagcctactattctaaggctcgtaattctgctaatgtagctgttgactacgttcaagtccgtaatattcgtaaacctaatggttctaaacctggttttgtaatttatgaaggacaaaaaactatcaaagttacacctagtttagaggcgattcgtccatttatgatttaggtacttttaaaacgcgaaaaccactttatgaaataaaattttcataaagtggtttttttattttatagactgaaattcagcaccaattgctaaggagaatggtggattttgcggtttcttaagaccaaattgagtgtaaggataaacatgtgaatagcgataatcaccttgtattatcggatgattttcgattttacttgatccattcaaggtaatctccgtgattataccagcaaaatcttgatcaaaagcaaatgataaaaatggtaaatcttgcaccgctaaaggcacaacacttacaatttgaagctgatgcatattttccttaataataactgaataaataccattattagtaatatgctggtttgcatttttaattaacggatctactttaacttttaatgcttccgaaacttcaattggaataaacatattatcttcatcaataccaacaacgccaaataagttgatagaaccattgatggaactgataacacccatgtaatcggcctcgatattttctgatcgagtagttcgactaacaggaagctgttccacctgaacattccgcaagactaattgggtaacaatttcccattttccttgggctatgattttatcaggtttttcttgatgaataatattcaagcaattctcaacggttagtggttctaagtagattttatccgctaaatcaggaattaaagttaacgcattcggattattgttaattaagataaccttataccctaatttctgacaacgttgaattgtctgaaaggttgtatattcagctgcgctattagtaccaacttggctgttagctgttccgagaacaagaatctttttaccagttgttcgaacagcttcatcctcatcctcaaaagtagaatagtaagtattagttaggtaaggaaattctccagcagttggttccacacccttataggtcgcaaatacatgagcctttttaatacgaaaatcgcggacttcatcagatcttacttgccaaagatgggcaatttgcgtatcaccaaagccaaaatacttagcttcttgtaaggctgccatgtcaaaacgattatctctaagtcgttgctctagtttaactaaatggcgtaacttatagaaatagaatgcgtcaatatgcgtcatcttagccagctcatcaacagtgtatccacgacggattgcttccaacaagtaataaacttctccagcacgaggatgtattaaaacgttaattaattgcgcttcacttagttgggattcatctaaggctgcttgttcggctgccgtagttgaatcaactgaacgaatcgccttttgtaaagcttcttctgcactacgtccaaaggccattaccgaacccgtcgatttcattcgggtattaagttgttggttagcatttttaaagctggcaaaagaccaagttggaaagcggactgcaatgtgatccatcacgggttcaatcaatgctaatgaatcatggcgttgaactcccgaaagtttaatttcacgtaagttttgtcccattaagatcttggcaactacattggcaatgggataaccagttgccctagcagcaaatgccgatgatcgatcgaaaaagggattgatccgggtaataaaatgcttgccatccgttggatccaaggcaaattgaacgtggcaaactccctttattttcaagatttcagctatctttagagcagccgtccgtagcgattgaaattcgacgtcggttagtgtttgggtgggactaaaaataatggaatctccagagtgaacgccaattggattaaagttttcgcccccgttaattaaaagctttgatccttcagcgtcacgaatgacaatcatttcaatttctttatagccaactacacttttttcaacagcaacttgattagtaatagaaaccttgaatgccgattcaagcatctccattagttgatgttcattatcacacttaatccggttagttttagttaaagatgcaatgggcttaatcaaaaccgggaatccaacccttttcgcaaatcttaacgcatctgtcacattttcaacaaccgtagtaggaatagttggttctttaatatgtttaagaacgcggttcatcaactcagggttgttaatattatgaatagtagtggttgttacccccaaggtacggacgttgagttcttttaaaatacctgattcatttagttgttcagaaagctgcaaagcaactgtatttccagccactggcaaaataacatctatttcattttctcgtaaaatttggatcaggctgttaaccgttaattcggcttcaataaatttaacatcaacatctaaacgaggaatcactgaatttgcatcactagtgacataaaataaattacgatcagtttcagcaaaatttttgattatttgaacggcggccgcttcactttcggtatcacgtccgatttgtgttggtcctgctccaataatcaaaatatttttagcacgcgatcttgccaaatcaacgaccccctcttgtcatcatttccataaattcatcaaacaattcggtagcttccgttggaccaggagaactatctggaaagaattgaacactgaaagctggaaaatctcggtgacgtagtccttgcacggagtgatcaattaaatcgtaatgcgttacgattaaatcattacgatctacagaattagggtctaccgtaaatccttgtccatgtgaggcgtacataatttcatctgtgataacagatagaattggatgattagaaccatggtgttcagatgataattccataatttcacagccattcgcaattgcaaaagcttcgtgtcccaatccaatcgcaaataacgggatattacgctcaacaatctgaatcatctcaatcacttccggaggcaaatcgcgcggattccccggaccggtcgaaataataacaccatcaggatctaaactaaaaatactatccgcagtagctgaataccccagaactgttacattacaatcccgctggctaagttgccgaagaattccgtatttaagccctaaatcaacgactaccacatttttgccatttcctggatttggaaaggctttgggagtagatacttgattaacctgttgattagttaaaacaatagctcttagctgatcaaaagcatgttccaaatccttaacaggatctataatactgcctttaatggttccggttgaacgtaattttttaatcagagcacgggtgtcaattccagaaattcctggaatgttttgccgttttaagtattcatctaaagataagcggcgacgtcgattaatggaaaccgcagctacatctctaacaatgacgcctttacaagtgggatcaaccgattcatagctcgcccgatcaattcctacagcaccaattgtgggttcagagaaaacaataatctgattatgataaatttgattggtaatgacttgttgatatccagtcattacggtagtaaaaacaacttcgccaaaggtggttgctcgcgatccgaatgctttacccttaaaaacggaaccgtcttctaatattaaatatcggtctgccataatagccacctccacagttaaatcatgttaattttctaagagaacaacgtcttcatcatcaatttcgcggacaaaaacgttaattttctcgttttgtgctgttggaatattcttacccacaaaatcagcacgaattggtaattcccgatgtccacgatcgacaagaaccgctaaactaatttgagctggacggttaatatccataattgcgtccatagcagcgcggattgttcgtccagtatagagaacatcatcaatcaaaatcacttttcgatcctttaaatcaagtttagcaagactagaattagctttagttgaacgtggttcagctgaattacgttgatcatcacggtattcagctatatccaattcaccaactggaatatcaaaattttcaagttgtttcagacgttcagcaattcgcttagcaataaaaacaccacgcgtttttataccaatcaatacgatgtcttcgacccctttattacgttcgataatttcataagtaattcttgttaaagcccttttcattgccatggcatccataatttctttttccatactcgccaagtcctccttcttctttcaaaaactcactaattcaattatatcagtaattggaactcctaaccttaatctaacattattttataagtatatagaaaaaagagttataacaaaagacacattggtaaatatcaatctttgttataactcttttttaaattcctctaagcttactaagtgtatcttgaaaaatttgtggtggatcaacttcaaatactagttcttcacctgtacgcggatgtttaaatcctagtaacttggcatgtaagaattgaccattaccttttaaggtatttcgagggccataaagtgggtcccccgctaccggatgaccaatatatttaagatgaactctaatttgatgagtgcgcccggtttccaactcacattcaattaaagtatagtccgtaaaacgttctaaaaccttaaaatgagttacggctggacgaccatcttcaacaatagccatttttttgcgatcttttttagacctaccgattggagcattgattgtgccagcttcttccttgaaattgccatgtacgattgctaaatactttcgttggttcgttttagctttcaactgcgcacttaagctcagcattgcttgatcatttttagcaaccatcaataggcccgaagtgtctttgtcgatacgatgaacaattcctgggcgtagctctccgttaaccgttgctaatggtgcatggtctaataaaccatttactaatgtgccattttcatgtcccggagcaggatgtactaccataccttgcggcttattaacgacaattacgtcatcatcttcaaacacaatatctaaattcattttttcgggttttacactaacttcgactggatcaggtaaagtaacgtcaattacatcattttctgaaactttataccgattggtggttggtgcttgatttactaaaatttgctcttgtttaattaaattttggatttttgaccgtgttaaatctggataatgattggtaactactttatccaaacgcccactttcttgatctgaaaccacaaatgaaaattgttccataaactctaactacccctcaattctttcgtcgcgaataatggcaatgaataatatgatgacaccaaaagttaagcacatatcagcaatgttaaaaattggaaaattgaaaaagtcaatttgaaacatatcaacaacgtattttaaacgaatgcggtcaataaaattacccaaggttcctgtaatcatgagggttaatccccattgatataataagtgctggtgctgtgtaactagtaaatagattaatacgactaaagctactacggtgattagataaaaaaatatctgatttcctgataaaatactccaagcggcaccatcattacgtaaattggttaaggacaatactcctggaataaaacttttaacagttcctaaagcaatctgattactaacagcgctttttaccagctgatcaattactaaaagtaataaaccaactatataactaaaccatttcataaaactttaattactagaataatccggtaatttctcctttactatcgatgtcgatatctaatgcggcaggatgcttgggaagtcctggcatagtaagcaccttaccagtttgaatgactaagaatcctgctcctagtcgaatgttaatatcgttaacatgcataacaaagtcacttggtgctcctaactgtttaggatcatctgaaaatgaatactgggattttgccatacaaattgggagatgatcccaaccatttgctacacattctttaattttcttaagtgcttgtggtgaatattctacatcactaccaccatatattttttgaacaattgttttaattttgtcttcgattcggccattgttatcgtataacttagtcattggtccctgattagtatcagccaaggcaatcacttcattggctaaatctttagaacctgcaccacccttggcccacgcatcggtaacaattgcagatacaccttccgcttcaatcaacttaactagcgtgttaacctcttggtctgtatcactaataaaatgattaattgaaacagttacagggatgttataacgttgcatatttttgatatgacgttgtaaattaatgtaacctttttggagagcttccacatcttcattttttaaatcagctagtttagctccaccattgtattttaaggcccgtaccgttgccacaattacaattgcatcaggttgcttgcccaggacaggggtcttgatatcgaggaatttttcagctcccaaatcagctccaaaaccagcttcagttacagtatattttgcatgtcgtaaagcagttttcgtggctaaaacactgttgcacccatgagcaatattagcaaaaggtccaccatgaattatggcgggagtatgactaagggtttgcactaaattaggcttaatcgcatcttttagcaacgtagcaatggcgccaccaacgtgtaggtctttaacaaagatgggttgaccatcatagttattggcaatcaaaatacggttaatccgttcctttaaatcatttaaatcttgggctaggcacaagatagccattagttcactggctacggtaatgtcaaatttatcttctcgaggcacaccactaaagcgccctcccaatccaataactatattacgtagcgcgcggtcattaatgtctaaacagcgacgccaaacgatggttcgaggatcgatattgagttcatttccttgctgaagatgattgtcaatcaaagctgctaaagtattattagctgcagtcaaagcatgcatatcaccagtaaaatgcaaattgatgtcgtccatcggaattacttgggagtaacctccgccggtggcaccacctttcatacccataacgggaccttgggagggttcacgtaaggcaatcattgctgaccccgtcaagtcatttaaagcatcacctaatccaacggttacggtcgatttaccttctccagcgggcgttggattaatcgaggtgaccagaaccaattttccaagttgcgtatttggtttctcggaaaaaatatcaattttggccttgtaatgaccataaggttcgactaccttttcatcaaatccggcttgtttagcaattgtttgaattggtaacatttcagcattctgggaaatttcaatatcattcattaatcttctaccccttttttgtcaaagctttaaataatttatctgatgacttacgactcattaatagtttatatcttttattgccatagtcaaaacttagtgacattttgccttgcgttacatttttaattttactaatgcttaaaattgtgaaattacttttgattacccgattaataatcagctcagaaccaattatttcaacggttcgactgacagtttgtacactgattactacaataaacaatgcaaaaaaagtcgccgtaatccaattaaatgttgttacttctaaccagaaaataatacctacaatcagaatcattagagtccatgaccagctgatcatgttatttaaaaaatctggctgataataaaaactttctactttcttcataccatgtacctctctacttaatgtatgttgtcagtggtttagtcaaatcagtcatatccaactcggaattttctactaaatcagctaatagttttccaataattggacctgtagttaacccagatgaacctaatccagacgctaccataatttgtggttggtttggcaaatagccaaagaatggtgcaaaatcctcagtatacgcccgtgtccctacgcgcgtattcttgaccatcgatttatctaaattaggaatcactcgttgcccactggctaataaatcgtcaataatttgatcactcactgttaaatcaaatccttgatcattttcatgagtagctccaatgagtaaagttccatggttagtaggaataaaatctcgttcaccttcaggcattaaaacgggagcatttgcattaacttgggcttgcccaggaagctctacttcaattaactgccccttttgaggacgagttaaggcttcgatgccaatatcgcttaaagtatcttttagccaagcacctacagctaagacgattaaatcaaatttttcaccattaaccagggtatctgttccatttttcgataaaacagctcgttcattacgtaattcgaactttgtttgattgcgctgattcaaaaattcaacaaatttttgtccatcgattcgtgcgccaccctcaactaaaactccattattttcagtttggataaaattaaaaagttgtttgatttcggcattatcaatccgccgaaatccctccatttgaggagcgtctttaattcggtccttagctaaggtgagtagtgcactaatcttttcattattatctcgtgtataaattacgccacttttaaaatagactgctggaggcattcggtatttttctgctatttggtacatatattccgccccttgacgagccaaattgtaccattttttatttcgacgtttagataaccaaggagcaataattccggcagaagctgtcgttgcagtccctttaataccgtcaaattggacgatttggtatgcaggaaaccgctctaaaatttcattaacaaaagttgcgccaacaattccatttccaataaccgcaattttcactatcaagacctacctttcacgtttaccccagaattggaaataatcagttctcaaagcaccattatataatttacgttttttagtggctttttgaccataataattttcaaaatctaaatcactcgtaataaaataacgactccaggtagttagcgaacccgttgcagcccctaattgacgataaatctttcgaactaactcttggtcccccattcgttccccataaggagggttaccaatcataacaccattcttcttatcagttttaaagtccttaactgcttgttgcttaaaggaaataattccagataatccagcttcttccgcattttcagttgcaatatcaatcatattttgatcaatatcgtaaccagtgatgtctaattcaacatcgtaattggccttttcatctgcagcagcacgaacccgttctaccatttcttgatcgacaatgggccagtcttcacaggcaaaatcacggttaaaacccggcgcaatattttggccaatcatggctgcttcaattaaaactgtaccagaaccacaaaatggatccacaagtggtttgtctggataccagttagttagcaaaaccaatgcggctgccatagtttcttttagtggagcagtacccttatgtagtcggtaaccacgcttgaataaactatcacccgttgtatcaagggtaatcatgacatggtctttatcaatggctacttcaagaccatatttagcccctgtttctggaaattgattacgccaatggaaaacctcacgtaatttttcaacaaccgcttttttagtaatagcttgaatatctggaacactaaaaagagttgattttttagatttaccactaactggaaaagctccatccacagggatcaattcgtcccaaggcaatgcctttacagattcgaataaatcatcaaacgttttagcttcaaactcaccaacaacgattttaattcggtcagcggttcttaaccataaattagttttaataatatcttcaaaggtcccttcaaaacgaacccgaccattttcagtttgaacttcatagcctaaatcttttaattcattttttgttaaactttctaaaccacttgccattgtggcaattaaattgaatttcttcatatttacttccctatttataaattttagttaaaataaaaagccaggataaaagataacttttaccctagctttcctgatttgtaaatctctataagccatgttttgtccaaaataaattctcaggaaaatttaaatttgggtaatcatctatctccagacaatgtctgcccccacatttagttcaattccagatgtgaagctcccctaccatagtttgggttgcccgctcgaggggtttaccgcgttccaacttattaatttcttaataagatcgtctctgtggcacttttcaaagctacttaagcatgaccgaaggctttagcttgttcacttgccgtcatttgcaaagcaaatgccccagcttattttttcaccaggcacgaacactacaagcatcgcagcttgtgcgagcatggactttcctcagtcagcagatgctaaccgcaattacccgagatttacaaagtgttattaaattgaattagatacgatgtgaactattatcagtatcttcaagttgagcaccaaacacgcgacgttcaaggtttgacaaacgtttcaaaacatctacgtttgtagctccactaactggtgctgattcttcaacagttccaccagcagaaacttgcttattaagttcgtcaactttgtcagttaaacgatcattttcattcttcatacgttcaatttctttaccgaaattttcgtaatctttaatcactgaatctaggaatgtatccacgtcagcaggatcatatccacgcatctttggtttgaattccttttgcaaaatatcttttggagtaaaattaatgttgtccatcgttgcacctcgtcgattacttttgttcaaattaccatgtatcattgtatcaaagattttaaaaaattcaaagaattattcgtccttttcttcatataacatggattcttcttctaaatcgtaaaaatcaatcgtttctacattatatgaattatgttcttgaaagcttcgaatggcatttaaatcaaatttagtttttccttcatgttcatcatcatacaacaaaagggcctcatcggtatggtttaacatgaagttttggtaatttcttaattgttgagggttttgataaggattttcgctaacattagcaaaaaaatctaccttggctttgattaaagctagtttctcgactttttcttctttccactgtttaccaaaatcactaaatggaaacattaaggctgtctgtaattctggataatccattttgagttcgtttgctaattcaagcgaccactgttcagttcctaattgtggcccagcaattatccacgtggtgccagattcaactttctcaattaactttcgtttcagtgcattttgaattacttttaatttgggatcctggtctgaaaaaattgataattcataactacgataccctgtcacccataatctactcattaacgctcacctcaatcctaaatttagcataatattaaattttgttttattttctatatgatatacgctttttaaactatttgtaatctatcaaactaaataccatagtataatagatgaacaggaggacgtatctttgaaatttaattatccaactgggtcaaaagcaaccactcctaaaatgagccaagccaaggttagcatgcctcctatttacggtaaaagaggtatgtccttagaagaagaacttaatgaaagtaacgcttattatctaagccacggggttgctgttattcataaaaaaccaacaccaattcaaattgtgaaggttgattatcctaaacgcagcgcggcacagattaaagaggcttactttagtaaggcttccactactgactataatggagtatatcgaggtaagtatatcgattttgacgcaaaggaaacaaccaattctacttcctttcctttaagtaatttccatgagcatcaaattaatcatatgaaggattgcgagaaagttggtggaatttgctttacaattataaagtttgtaaaattgaacaagatatttctactgaagacgaaagatctttttcagttttgggatagtaaagaaaatggtggtcggaaatcgattcccctttcggtatttgaagaacaaggatatcaattggaataccaaatgaatcctttaattccatacctaaaagcggttgataaaattatagagaatttataaaaaatcgattttctaacagcaaggagattatctatgaacaacggaaatcagtaccaaaatcgacccatgcgacgaacgcaacattcgaaaatgggtaaacaccctaaacccaaccgacattcttccttaattaagaagttattgttggcagcagtagcagtttttgtagcgatgattattttcggtggtgggctctttatgtactatgctcaaagcgctcctaaaatcacggaagctaaattatcgagtgataacgccactgtaatttacgataaagacggtaaagtattaactcgtctgggatcacaaaatcgtgaatatgttaaaaaagacaagattccaaagactttaaagaacgcgattgtttcgattgaagatcgtcgcttctacaagaataacggtgtggatcccattcgtattgtaggagcaacagttgctaaccttacaggatcttctttaggtctacaaggcgctagtaccttaactcagcaattggttaaattatctgtattctctacggacgcatcagatcgaactttaagagttaaggctcaagaagcttggttagctttgaaggttgataagaaatatagtaaagatcagattcttgaattctatattaataaggtttacatgggtaatggtatttacggtatgcaaacagcggctaagtattactttggtaagtcgcttgaaaaattagatttagctcaattggctttattagccggtatgccacaatcccctactaattacgatccgattagtaaccctaagtatgctaagtcccgtcgagacacggttcttcaagccatggcttctaataaagtgattactcaagctcaagcaacagaagcgcaaaaagaaagtatctctgatggactttcagagacccatgaaacttcaactaactcagctaagaaaaacaagattattgatccttatattaaacaagtgttacaagacctttctgataaaggatttgatactgctaagggtggtttgaaagtttatactaacatggactatgcggctcaaaagaaactttatgatttagcaaataatgaccaaacggtacaatttaacgatgatgagcttcaaattggtgccacgttagtcaatagtaaaaatggaaaaatcgccgcgatgattggtggacgtaaaactggtgatgttacttatggtttaaaccgagctgttcaaactgaccgtagctctggttcaaccgctaaaccactaatggattacggtcccgcatttgaatatctgaagtggtcgacgtatcgaaaagttaaagatactccatttacttatcctggaacagacacaaaactttatgactttgatcataagtttaagggaacaatgacagtacgagatgcgttaattcaatctcgaaacgttcctgcgattcgaaccttacaagatgtcggcatttccaaggcaacaactttccttgaaggtttaggaattacaagtaaggaaccctataaccttaataatggaattgggttgtacatttctacacttcaaacagccgctgcctatgctgcctttgctaatgatggtatctatcacaagccaacttatattaataaaattgatactaatagcggtaaaacctatacctacaagtctaaaggtgttcgtgcaatgagtaaggctacagctttcttgatgacatcgattctaaaaggagtcacaactgactcgcaaggctctggtactgcagctaatattactggcatgaatatggcttctaaaactggtaccgtagcctattcgaagaaagctaccgaagcaaatgacattccaagttcagcatctagtgattcttggatggctggttataccaaggattactcgttagctgtttggactggttatgatcatccaaatacttcgactggttacctaactcaatcacaaactgagttagctcagtattattggaagtatatgatttattacctatctcaatactcttccaacgaagactggaccatgccttcaacagttggtaaaaaaggtactaaccagtattatcaaattggtgaagattatgatgagactggcaagagtgatgaatactctaagaacaacagtagcagtagctggtcaagttattctagcaagcattcaaactcttcttatagtagtcgttatagtagttctgatgctgacgacgatgatagtagcagcaacgatacttcttctgaagataactccagcacaccatcctatagctctaacgtaagcagtaatgatacgacaagtgatagcacttctactaccacttctacttcaacaacttctactagctctgctagtgattctgaataactaaaaaagatcatctcaatcaatgagatgatcttttttagttgtctttagttaatttaaccagtggaatttggatatgcttcttttgattatctttattcgacgaactcgtatcctgactagtaggtcgagagttcaaactattttcaacctgagctggagtggttaagtgacgttgttgccaatttaacaaaattcgatccatatattttaaattatatgcttgatttaatacagcttccttaagagctaaacgtattaaatcataagaaaaatggtcggtatcaatccattgcgaaatggtttcaatttcaattggcgataaaggtcgaccaaactcaatctgaatttgatcatagatattattttcctgcttagcggtcgccaccttttcagtttcttctactttattatcaaataacgcaatcattttttgataaagcaggctaaaatcataaaaatcggttaaccgcccctggtcgtcttttcgctgtttaatttctagaatctttttgtcttgtaatgcttggatggtcgaaaagaggttttgactagtcattccgaggctatcagcaagtttatccatctgaggaaacgaatttccccgtgattgctcctttttaatctgtagataaagcaaaaactcgtcatttgtcatgccgagttttgcatagttatctaataaaaagttagcaatgctgatactcccgtcctctaaaagactaagaagtaaatcttgcatttgttcctcctattagtatgttgtaatggttttaagttcttcacccgttttaaagttaatcgttttagtaactaatctatctttttggttgatataagaaaccatccagaccggtttgtttttaataattccaaatcgactagaagtaattttcttcagattaggatcactttgaacactagcgatggctttttgttcacttacgcctgccgtttggtcatagactgtagcctttttgccgttatccgtaagcacaacgaaaatactatttccattagccttggttccagagaccgtatattcaacctgattatatacaaatcgagttactcgatcgactttctttaaatcggtatttttctttgcaatttcggttgctaccttactgtcatagcgctctggtcgattaatttcttgcacgataataaatattgagcccacaaccgttgcaatgacaataaaggcgattaaccaaaatggatgcttattatttttttctgccataatacccctcgtctaacactaacaaaatgattatatatcaaaagtcagcttcaaagaaagctattcttgattattaaagaaattattcactctttctttgacttcattaatattacctaaattggcatttacgccacttggcagctgtttaataaacaatttaccataatctttattaataatacggttatctaacattactgctacccctgtatcatcactattacgaatcaacctcccgatcccttgtttgaaagttaacaaggcatctggtaagacaaaactcataaaggaggagcgcttattcttacgtgcaaattgaaccatccgatcttccggtgagcggaatggcaagcgagtcacaattaaatattccaaacgatctcctggaaaatcaactccctcccaaaaagaggctgctccaaacaaaatagcattttcttcatcgttaaactctcgaatgatttttgctttagaaccatggataccttgcgcgataatcctgcgactttcgtttaaatcagaatcatgtagcctattataaacatttcgcaaggtttctaaagaattaaagagaactagcgtttgacggttaatatccctcgtcaacgcttcaattgcctctgccaaaaagtcagcatattgatcctggttgctttcataatcaatcgtaaagtcgctttgtagtacttcaaaatctaactggttttcgaagtccacgccgcgtctgaaagtccgtatcgatgtctcgggtttatgcaagccaaattggtctaagaagtaactacgcttatgttcaaagaatagcgttccaccaattaaaagaaccttatgataaaatggttcgattttttgccggtagaattctcccgtatctaaaatttctttaccaatccgaatacttcccggatcatgatttggacctagcgtgatccagtaaatattttgattgagatgatcagtaatttctcgaatagcatcgtagaatttcgttaaattactttgaaaagctttgatttgagcccaatcatccctaatttccggagtaagttcttggtctttaaaaaagcgatctaacgcatcaaactcaataaatgtattggccaattcctgaaccacttgatgaaattcgtgcttagccatttggttaataacattatttttaatgacaatctcggctggttggttttcatataaatttttcttacgaggagccacaaatttatcaaatagcttttgttgaatctccgtaatttgagtattaatatgctcgagactgttaacaaagcgccgaatatgaaatccagctaagggttgatgtttagtcgcttgaattaaattgcgcttatggttcattactaaacgactaactaaccgatgggtttccatcatcaactcgtttaagtctagaaatttttgattcatattggaaacaatcgttggaaaatgctgggcttcgtcaatcactagtaatggttgttgatcagattctccaatttcatcggcgtgtaatgctaaataacgatgattggtaataataaagtctgcatacttcagctttttcatcgctctacggtaaaagtcatactcaaagaacttagatttcgggttaagcacggtttttccatgatgtcttatgccatcgacgaagttagaaaagttaatatggtggttaatttcatcaaaatcaccagtatccgtcttagtaagccataccagaatcttcatggccaccaagcgagaatctttgcttaacgtttgatgggtaatacttttcatgaaggcttctaaattaagataattactactccctttcagaattgcaaactgcatcggcgtttctaaaatagcattcaactgctgacgtcctactgctagaacttggttttgtaaaatggttgtaggtacactaacaactactttacgctgttgttcacgtgcaatataactcaatgggaataaataacccaaggttttcccagatccggtaggagcttcaataaccacatgctttttgaagccttccgtaactgaaaactgttgatgggtgaaattcataattgaaccctgtaatttacgccagcttaaggttccattgtataactgttccttttctcgttttccccgaggataaaccaatttctcgtctgcttggtgttcagtttgtaaagcaatcggcttttttaaagcaacgccatcgaccaccattaaatcaacatcaattttttgcggattttgtttgttctcatgtagagcgtcctttaaaatcgatagcgtttggcgtggtaagtcttttcctaactccactaaacgttctaacgttacaatgggaagttgttggagattttttttgatcgcaattagcaaattagctgtagcaatggcgtcactatcagcagaatgtggatcatcatgttcaatttttaaatagctagttaaatcacgtaatcggtaacccttggtaaatgaaaagacaatttgactgagggaaaccgtatcgacagctggaatgttaagttccggatatccactacgaaccaattcttgattcaagaagggaaaatcgaattctacattatgagctacaaaaacagtatcgactaattttcgatatacttcatctacaatatcattaaatttaggggcattttgcacctgctcatcggtgattcctgtcagtttagtaattcccgctggaatcggtctttgcggattaaccttactttgaaaggtatccacaatttttccattttcaacaaaagcgcatccgatttggatgattcgattgtcaccatcgaaatcactacctgtcatttctaaatcaacgacggcatactttgttttattcatttcacatctccactttgttatctacctattaattttaccaaatgtttaccttctctacatagaacaattgttttatttaaggtatcatttaatttggaccaaaaaggagtatcgtcgtggaagaaattataaagagtagtaattcaaaaataattttaattggcgaacatagcgtcgtctatggacagcctgcaattgcattaccaatccgtaatgttaaaactacggttaaaatccaaccaactaatggcgacattgaaatcaaaagccgctactttaatgggtctctaaatgatatccatagtaatctacttggtattaaaaatctaattaaacaaactttaaacgagcttaatcgccccaatactaatttattaattaccattgatagtgatgttccagccgaacgcggaatgggctcttcagcatcgacagcagttgctctagtacgggccctatacgcgtattttgaacatcccttgacgcgaacgacccttctaaaaactgtcgatatttcagaaaagattattcacggaaagcctagcgggctagattctgctactgcaagtgctaataatccaatctggtttaaaaaagatggcaccattaagccattaccaatcaacgtcgacgcttacctcataattagtgattcgggaattaaaggtaaaacgagtgaagcagtcgaaatcgttaaaaataagcttcgatttgactctgacagtagacttttaatcgaaaaattgggagaattgactagtcagactgcgactgtcctccgtcaaaatgatgtaagtacgttagggaaaattttaactgaagcacatactaacttacgtcaattgggagtcagtcaccctgctgttgaaaaattaattaaaattgctaatgattcaggtgcgcttggcagtaaattaactggcggtggtttaggaggatgtgtgatttcacttgctcctaatcttccagctgctgaaaaaattagtcagcaacttactgctggcggagccacggccacttggattgaaaaactttaaaagtaggtttcgatacgtatgaatgaaaaacatggttttgcaagagcccacactaacattgcattacttaaatattggggtaaaattaactcggatttaattctacccgctaatgacagtatttctttgaccctcgacaaattttataccgatactgaggtaaccttttcggatgaatacactagtaatcttttttatctaaatcatcaattaatcgatgttaaaaagatgcaacgtattaatcgcgtcctagaagcggttaaaagtgaatttggttatcaaggttttgctaaaattgaatctgaaaatcacgttcctactgccgctggcttagcctcctcagcttcaggcatggctgctctagccggggccgcagtgagtgctttaggttcacatactgatttaactaatctctcacgactagcacgtttaggctccggttcagcttcgcgctcagttttcggcgggattgtgcattggcatcgcggatatgatcatcaaagttcctttgccgaacaaattgtgtctgaggaccaaatagacttgaatatggttactatcgtcattgatcgacgccaaaagaaggttaaaagtacgctagggatgcaacatactgctaggacttcgcctttctattctgcgtgggtggaagctactaaccaagcaatcccagaaatgattagtgctgtacaaaacaatgattttactaaaattggtgaattagcagaacacagtgcagccatgatgcatgcaacgactttatcttctaagcccgcttttacctattttgcacctgaaactattcaagcgattaagttagtcgaacaactgcgtgaaagtggaattgagtgttactacaccattgatgccggacccaacgttaaagttctgtgtcaatctaaaaacattacgcgggttaagcggttctttgccaactactttgaccaagatcaattagtcgtggctaagcctggtagtggaattaaatttactaaaaactaagaggaattttaaattgataacagaaaaagctcccggaaaattatatattgctggtgaatatgccattgtcgaacctggcaataatgccgtgctagtggcaattaatcaattcgtcactgccagccttgaacctagtaaattaaccgtcggaaatattatttctaaacaatatcaaaataatgttctttcctggcgacgtcgtggtagtgaattagtggttgataaccgggacaacccttatcactatatcctttcggctatttcgattattgaagaactagctgttttacttaatcgtaaattaaaaacttataatttgtacatcaacagtgatttagatagtagtgatggtaaaaaatatggtctaggaagttctgcggccgtaaccgtcgccaccattaaagttgtggccaaattttataatattccgttaactaaagaactactcttcaaacttgcatcaatcgcgcatttagacgtgcaaggaaatggttctttgggagatattgcagctagcgtttatggcggttggattgcttaccaatctttcaatcgagactggttaaacagtatgcgtcgtactaaagatttagaaacaatcttaagaacgccttggcctcaattgaaaattgaattactcactcctccatcagatttacgcctttacattggttggacgggctctccggcctccacttctgatttagttgatcaagttgctacaaccagttatcaagaaacggatagctatcatgagtttttgaccaaaagcgcatcttgtatcaataagatgattgatggttttcgtgatgctgatattacagttattcaacgtgagatcactaacaatcggcacctattacaagagttaagcttatttagtggcgtttcgattgagaccacgacgcttaccaacttttgcgatattgctgaaaaatttgatggagctgctaagtcttctggtgccggtggtggtgattgtggcattgtcattatgcccaattccacgaagacagcaaaaatgtttgctgaatgggagaaacataatatcaaaccccttgatttagatgttcaccatgtcacagaaattaattaggagttgtcatgaaaaatattcattctcatcgtaaagatgaacacatttcattggctgaaaaattttacagcccaactgccagtgctgggtttgatacaattcacttattaccaaacgcattacctgaaacgggaatttcagaggttagtttagaaactaccctggcagggctaaaaatgccccttcccttcttcattcaggctatgacgggtggaagtgcctacaccgccaaattaaatgcacggcttgctaaaattgcgcaagaaactgatttagcgatggccgttggctctcaatcagtcgctttaaaatatcctgaactagcagacacatttaaaattgtgcgagaaactaatccccaaggattgattatggcgaatgtcggggcggatgccagtgttgctaaagcgcaggcagctgtagacatgcttcaagcgaacgccctacagttacatatcaatgttgctcaggaactagttatgcctgagggtgaccgtacttttgattacctagatcatattgctgaaatcgtttctaacctgaaagtacccgtgattgttaaagcggtcggtgcgggaatgactcatcaagatgccctcgccctaaaaaaagttggcgtaaagtttattgatgttggtggtcgaggcggtactaactttattcaaatcgaaaatgctcgtcgtcacactaaagattttgattttatgacatcgtttggtttaacaacggtagagtcacttaaatcaattacggttgatggcttgtcaattaccgctactggcggtattcgtaattcaagtgatattattaaaagtctggctttgggggctgataacgtgggaattgcgggctacttcctccatcagctactccaccatgacgatacatttatggttgaaatgattgagcagatgaaataccaattaaagagcctcttggtactgttgggcgctaaatctatcaacgaactttctgagaaaaatttattttaaaagtgtcgttaaatatgttctcgattttgtcgggggcatatttttatgagcatcaaatatggtttaattacaaaaaactccgtactgttattattctcactaataacagcgcggagctttttatcttaacaattttattagaacacaactaatttaagcattaatcaatagctcaccttatcttttatgacgaactaccggttgaatcgaccacagtagaatgtccattaacaaacttatcataataaagggaggccagaagaatacaataaacaatgcaacaatatttaaaatcagcgatgctatctctgtaatgtataaatgcttcaacctatcattgatttttaaaacttcatttctcaccattgagaaagaaatgttgtaaacaatgacgttgacagcgtacagccaagctgccgttgatgagtagatgtctgaaccaaaccaggctgtggtagctggtaataaagttgcccaaaacaatagaaatatattggtatatagaattttatgatttactgttttcacatgaagaaataaattatgatggttaacccacatgactgctagtattgtaaaactaacgatgtatgcaagaaatgaaggagcaatggcaataatcgctcgcatcgaatgatcatctgtaggtagatgtatgtctaatactaaaatagtcattataatggcaattacggcgtccgtaaaagcctcaaagcgttctttattcataataaattgcatcctttttatcatttttttataccacaattataacatttgtctattaagtcaataaatatccaacagtatctagtagccaacacatcaaaacagctcctcgatatctaaaaaatcccccaaaattggaggattttttagattaatatttgatatttagtaatgggttatttttgatatcatcaatggttttagtacctgctagttgcatcacaatttcaagttcatggtctatatgttcaaatacagattgaacccctttggcaccacctaaagctaatccataaattactggacgacccaaagccacgatgtctgcaccactagccaaagctttaaatacatctgaaccgcgacgtacaccactatcaaagataattggcacttgcttattaacggaggtagcgatatcttccaaaacatcaaaagatccaggtcccccgtttagctgacggcctccatggtttgatacataaatgccggctgccccagcatcaattgctcgaatagtatcctcaggagtttgaattcctttaacaattacgggtaattgtgtgtaatcagcaattcttttaacgtcttcaggtcttatattttgagctgcagaagcgtagatttcttcaattccttttccttgaccatcaccttcggaaaacttagttaagttagccattggaagtggaaatgcaaacttatttttaatatcagcttctcgataaccatcaacagtggcatctacggtcaaaataattgctttaacatgagcttttttagcctcatctagcaagctctcattaaaattccagtccttactcatgtaaagctggaaaaattgaggagcaccttcaccagcagctgccgtatcagcaatagaaactgatgaatatgtgctttgtgccattaagcctcctactgcggcaagacctctagctgtatctttttcaccttgtgaatgtgctaaaccttgagctgcagctggcgccatcattactggagtattcaatggaattccaaagatttctgtatttagttctggtttttcgattccactcaaagctttgggcgcgatttgtcgatgctggaatgcagttcgattttgtcggagagtccattcatcttcagaaccaccagagatatatccaaacccaccagttggaataatcttttcggctctttcttccaaagactccaaatttaaaatgtcaattttttcttcacgatcactttgttcataaccattaaccattgtcataatatatgccttcatccaaatcactactaattttaagattaactattctaaaatttactgatagcaaagaacagaatagtaacagatttctacttgctatttcacttacttattgtaagttaatcgttaattaaatgcaagtattaatctttgaaaaagctcattagttgtaataaactgacgtcgagatgaattgattattaaactaacacccgttttgacaactaaattagactagttttagagcgataaccaaatctttcaaataactagagagaaggaacgtaatgaaaattaagaatgatttaatttacgatgaaattcacgctttaaaagctgacttataccaacctgataatgcttccaagggcttgattattgatatccatggcggaggctggtttagaggtaataaagctaaagatcaagatttagcagaagctttggtaagggacggattttccgttattgttcctaactatcgactaactccagacgcttattatccagcacctttagatgatatggatactttatatcactggattaaaacttcttcaaaattgtttgatagtgatcgaattgccgtagttggctcatctgctggtggaaacatggctgtcgaaatgggaattaaatatggactcccgattgtttctttgtctgggattcttgatattgatgattggttaaatgagcatactgccgtaattgctcaacctgatcatcaacaagattttacaaattccaaaagttctgaaataaaccagactggtcaaaacgacgctttttataaatggtttgttactaattattttaacggaaactcagatcaatattcactagcaaccccctacaaacatgtcaacagtcaacccggaccgatgtttttagcaaactcattaaatgaatttgtgccaacaagtggcgttttagaaatggcaaaaattttaactagtaaaaacgttcccttcgtggaatggatgttacctggtactcagcatgcaaaaggatatttagaaatcgtatatcctactgttttaaatttcctcaatcaatatatctagctctcgattaaaaataattgttactttaacagacttatctggaagatatataaaaaaactaccttgaaatttattcaaggtagttttttcaattcaaagtactactaattttacgtccaaagtcagtatggtcaaaattatcaataatttgttttaattcttgatattttagactagccccaaacagtggactaccaggttcagtcataattccatcagtgagcttataatgaaccacttgatcaaatcccattgaatcaacaaattttgttacttcatcaacagctgcatgattatcacccgtaacgaacaaagccttgcgtttagggtcaccttttggtaaagcctcttcttgaagattgtggtatcccatatgattaaacgttttgacaatagtactgtccttaaagtagttttgaacttgctcactagaagttaaggttggatctaggacctcctcgcgaatgccatccgtttcccaccagtagttcatcgcatcaatcactaatttacctttaagtaacgtaggatcgatatttttataacggcttagtggaattgctaaaatgataatgtcactattagcgaccacttcggcattttcagaagcaatggcgcctggaagcagagtactaattgttaaatcaattttatcaactgaacctgaccctgaaattcgtacttcatatccggcctttaaggctaacccagccaaaacaatccccactttaccggcacctaaaattccgactcgtttaatggtcattattctgcgccccctttgctttttaaaatctctttaactctagggatgacttttgtggcatatagttcaatcatacgctcacgttgtgcagcggtctgattaccagcaccatacactaagtcaaagcgacctaaattaagtaaatctatggtccgagcaattcgttgcgcaaccgtttcaggatcacccacataaaatgaaccaactttagtttcactatcaaattgttcacggctcataggagcccaaccacgggtaagtccgattcgatcaaaattcgctttaatatttttaaaagctacttcaacggcttcatgattgtcatctgcaataaatccgtgagagtgaaccgcaattggtagatctggagtcccaaatttttggttagctttgtgatacaaatcaatatacggtttgaatcgatcagcttgcccgccgataatggcaattatgactttataaccaaaccgagcggcacgaataatcgattcaggagagccaccaattccaatataagtttccagcttaccactctctgtcttaggataaacttcctgctcctttaaagctgctcggaattttcccgaccatgttacggctttttctgtacgtaatttatcaaatagttctagtttttcattgaacaaatcatcataatcagttaaatcatatccaaataaaggaaatgattcggtaaaggaaccccgaccaagcatcacttgtgctcgtccattagataagccatccagtgtggcaaaacgttcataaactcgaacaggatcatccgaacttaagactgttacggctgtagctagtttgatcttttgagttacggatgcgattgcagccaagacagtttcaggactagacacactgtaatcagggcgatgatgttcaccgactccaatcacatcgattccatacttatcagcaatttcgccttcgtgaacaatttgtcgaatcgattcagcggctgattttaaactaccatcttcattggcaacaatatcaccaaaagtttcaattccaaattctaatttatctacgtttaccatgattaatccctccgtttacttactttttgtaagttaataaagttagattaatacatttgtcgcaaaaaagcaacatttaatgctgataaacttaagtcatattgccatagtacttgtaaatatttaataaacgttattttaatttttgcatttaaataatagttttatgtccttctaaagcatttacgtattaattaattttaaaaatttatcaaggatttcgtaataattgcttcacaaaaatgtaacattgctgtaatatttatgaaataaaagtgaaatagaaagaagccagtaaaatgcaaatcaacaaaaaacatcggctagcatgggtactaggaatagcttgcttaatattaggtattctaataattcaacaactctattatcaatcgacacatttttggacaaataccacgattgataatatcaatattagccacctcaattatcaagaggcagttaaaaaaattgagaaccaacgggtgacaccaagttatactattaacgattcccaaaacaagaaggtgttagctagtaaaaagtttaataacattccagttaccgattatgaaacgcaattgaagtatcgactaactgaacaaaggaatcgactatggtggtcgattaaccatagtaccaaacaatttaaagctttaactttatataaaaaaagcgccctgctttctgctataaaaacagatcaaccgtctttacaaaaacatttagaagcaattaatgcttcacggaccatgcctcaaaatggaaaagtaatgatccaagatggaaaagtttctttattgtccgctcactctggtaatcggatattggtaaatcagaccgtggaaaaagttagtgataaacttttaaatacacctaataaacacgttgaaattactgccccattactttctgaaacatggagtggaaaaaccacggctaaaaaaatcagattactattaaaaaatcagtttacgtttcgagctaaaggacaccaaattactggtcaagtaagtgatttaatagaaaatggaacgattagtaaagatggtccatcaatcgacttaaagcccgcctataaattcattaagcgttttaaccataaatacacactttctggagcacaaaatttaacctttacaacagtccaaggcaaacaggtatcttttagtaacgctgagggcactctaggttggagtttaaatacggatagtgaagcacaacatcttatccaaagtttactggcaggaaaaaataatgtttcagctaaaaacttcaatcaggctaatcaaacgctaaatcaaaaaaattggcataaaaaaatagctaattccgatcatatcgaaatagatttaacgcatgaacgactatatttagtacaaaatcaaacagtggcgcaaaaaattcggattaacactggatctcccaagattaatattgctaccccaacaggcgcttatttcattaaattcaaaattgcgcctataactatgcgaggttatgaaaaaaatggagaaccatataaatcttatgtgccacaagcagacaatttaaccgatgacgggatatttattcattccgctccatgggtacaagcctctgtatttggtaatcctagtcagcgttacaatcatggctctaacggttgtatcaacattccacctaaggatatggtgaaactatatcaaaaaacaaccgtagatgaaccagtaattatctatggacaaggttaatccgtttggaatctatctccaattaaacatataaaaaataaaagaaggacatccctaaaggacgtccttcttttattttttatttaatttttagttcgctactaaccgccttagtgagatcttcaactaatttttctccactttgttctgttttatttccagtagacattatcgcaatcgtacagctattctgaccagttccaatctgtcccatactattaataatccatttaccatttggcatttgcttccaaccatttttcaaacaaaaatgcttagaaccgactgatatcccccagttttggtcttcagctacatgacccatcaaatattcaatataacttcttgaagtatcactaatataattgctttgataaaaaattatattaagtgttttaatttgatcaagcggtgtcgtagccgtcaacgcccatccagtggtcaaagctaccgatccatccattccaacattactgaagtacctagctaagccactatatccaccaatttgattataaacattagtagccgcatcgttgtcactatgctccatcatcttttgaatcacagcttgttcgttaacatctagactctgaccagctttatgtttctgatgcaaaagttctactaaaaaatcggctttaataatactagcagaaggataagtggttcttttactattagttgtttgataaatatggttattcttttttgaatagatcgcgacggatacttctgcatcagtattttcaagataaggacttaaccgcccgtttaaaactttctcatcattgaccttaggtgtagtttctttagtttttttaataagatttctttcggcacgactaaatgcacgttcttcctttttttgctttgcgataaagtcactgcgcattgcattaacagtatgaatgtcattgatttttactgcttctagtattatcgatactatcacaatcagtgccaagagtgcttctaataaaaatagaaccaaccctcgattattaaataactttttcaattcctcaaccataggtatcgtatagcctcgctactttaaatttactcttctcactttatcggatagaacatcagtacattataactatatacccgattagtgtaaataattttctagcgcttatctggttctttgaagacctacgataatgaaaattgatccaataataattaaggttccccagtctaaataaacttttattattaaaataaaactaactaaaagagcaacactaatgctgtaaccatttagtttgaaccaattaaacatttttgtaatatatcccctttttaataaaaaaatgatcaactactcattcatcacctaactataccgtttgcttaaccatcctagcattaaattatgattcatccccgtttttattgtgagatttgtttttcaaagtattatcttaaaaagctaaaaataaaaaagagccctaaaattagcttaaccagtcctaattctagagatcattttttaaattaatttttattcactttagtaaatcaaaagttcatccgtaaccctttgggatagaagtttttaaccgtaccttgtactaacttaccaggtccaaccactgtatcatctacagctacggctacccaacctttaccagcagtagttgtcgacagaacgtcgccatgcacatattgacgccactcctcatctgtaattttaacaacttgttggaattcatcaacggggagggccattaaaaggctctgactgggttcaaaacgatttttcttaaattctcccagctctaatccaggcttgatataccttaatccttctaaatctaaacgctcactttgataatataagcgatctttttgaaccattaaatgagctaaatcgaaataatttgaatctttcaaaaatgctttagcaaaagtctcccacaatttcacctgggtcttgtttagggactttgaattgcttgattgtttctttttcttcttagctcggggcttttcagtgggcgtctccatcccgtggttgaccagttttgccataaaatgtccttcaccctgaaaatgatgagggaataaacgtaccgccttggttagttctggattgccgtcggcccactctggacgccctgcatccatgtcatctcgtttagggacatccaccaatgctagattttcgtagttatctaataaccaagcgataatttgttcatcttcttcaggagcaaaggtacacgtcgaataaactaaagttcccttaggggccaacatcttcatcgcgctctttaaaatttctctttggcgattagcgcactcagatgggtaatctttattccaatattccatggctgcaggatcttttctaaacattccttccccagaacaaggcgcatccaccacaatcacatcgaaataattggcaaaacgatcttccattcgatcaggtgactcatttaaaatcactgcattctgaataccaaagcgttcaacgttctcagccaagattttagctcggcctcgattgatttcattagaaactaataacccttgttgatctatgaaactagctaaataagtagtctttccacctggtgcggcgcacaaatctaacactttttgacctggtttaggatgggctaattcaccgaccagcatggcacttggttcctggctgtaaaccagtccactttgatgatcgatggttttcccccgtactttaccaaaatagccccaagctgaataacccacagattgttgcattgcatgttcatgaagatgtccgtgatatttaagcggattaatccgaaatcccttttgaacaggattatcgaagctcgctaaaaaagcttcggcttgatccccaagtaatttttcatattttttcttaaaatcaactggtagttgcatttttaaatattccttctattctttattcattcgccataaaactggacttaattatacagaaaaaaaacgggttgagccaccttaacaattcatttaacttcctaaagtactctagttttttaaatttaaccatgttaacttataagtaatacagaaaatagtaaaaggagcgatcaaatgcatcaaaaattaatcactcttgatttagatggcaccaccttaaattcaagtagtcaactctcacctcaaaccattaaaactatcaaaaatgccacggcagctggacacatcgtttccattgttacgggacgaccttatcgcatggcttgcgatatttacgatgaacttagccttaaaacgccgatggcgaattttaatggggctttaacacatattcctcaccaaaaatgggatggtgaatattccagaaccatcaacaaagcggtcgtctacgatctgatgaagcataaagatgactacggtattcaattacttgcggttgaaagtaaagattcattttttgcggatcatgcggctcccgcttcatttgaattttttcctcatgaaatttccaatgaccaaattttaaccgaaaaaacgctaagaactaatccaacttcgattacgattttagtggaacctaatagtgctcaaaaagttaaaaatcaattactacactattatggtgaatatattactgtcggcgtttggggcggaccccaaagtgttctggaaatcgtttctaaaggtattcagaaagccaaggcggtggcctacctagcagattactatcatattgatcgacaggatataattgcctttggagatgaacataacgatgctgaaatgctagattatgtaggacgtggagtggcaatgaaaaatgctacagaacgaattaagggaattgctaatgatattactgaatttgataataccgaagatggtgttgcaaagtatctcaatgaatatctcggtttagccgaataaaaaacttcaaaatcactgatctttcagttgattttgaagtttttttattatttttcgtcgctctttaaagttccggcaactgaataatgattttttgacatttcatttagcacaacatgcacgtgttctgctggagcccccgtgtttttaacgacggctgcggtaacgtctttgactagtccacgaagttggtcttcattccgaccttcgattaaatcaatatgaattaatggcatctttatttcctccttaaattatccatttaaacgcatatatatattctcatgaaacagaaataattcaaagtacttttctgtgtgataaactatgattaagtaatttacggaagaaggtccttattatcgacaataaatattctgcatgtacaagttttttagctggtaaagcagctacggctgatggatcaaccatcattgcgagaaatgaagatgctaaatcagcttggcccaagcattttaccgttcgtcctcatgatgaagcagctaatactgaatttaaatctagtgataaccaatttacgatgtcccttcccccagtgcgaggaaaatataccgccactccggaatggaccactgaattcggcttgtttgaagaagatggtatcaatgaatatggggtagcaatgagtgccaccgagagtgcctacactaataatcgagtcctcggttatgatcccttagttgaaaatggaattggtgaagaggcaatggttacagttactttgccctatatcaaatctgctcgggaaggcgtgaaatacctcggcgctatcattgaaaaatatggtaccaacgagactaatggaattcttttctccgacgctaatgaagtttggtatatggagactgcaggtggacaccagtgggttgcacaacggattccagatgatagttatgcggtagtttctaaccaactttctattcaagaagttgattttgaagatccagaaaactttatgtttaaggctgatcttaaacaatttgttgcaatgcatcatttaaatcccaacccaaccagttttaatttcagaaacatttttggtttaaatgatctttctgatgaatattacaacactcctcgtgtttgggaaggacagcggattcttaatccagaaattacccaaagtccagttagccatgacttaccatttattcgtaaggccagccgattaattcaaattgaagatgtccaacaaattttaagttctcattatgaaggaacgccatataacccagttggaacaggctcagaagctgaaaaacatcgtttccgtcctattagtcttccagctactcaagagtctcacatcttgcaaattaagcctaatcaacctattgaagttggtggaatccattggttagccatgggggttgcggctcaaagtgtatatgtgccgttttttgcagggatgtcggaaacgcctgaaatgtatcatcatggagctaaagtttacactgccgactctgcctattgggttttcaaactggctagtgtcttaaccgatgcgcattataaggagttcgtaaaagagttaaatacaactcgttcaaaagttaacattcaaatgcggaatcaactgcatgattttgaacaacgagctttagaattatccgatacaaccgccctagaagaattattaaatcaagctggaaacgaaattagcgctacagcaattcaggcttttcaagccttaagtgccaacttaattactaagtcaaccgacttatcaccattatattaccaacacaatgaagaactttaatcaatcgtttaggagcgtctcttctgaggcgctttttatgtttttaaattaaatctgattaaaattacattacctcgatgaactggagttggacattattataaataaacttgtgcatgacaaaatcatgtggattgccttgggcgtatttttagttagttgtctgctaagccctttacagttaggtgacattaattggaaaaccatttttgctctatttgctttaatggtggtggttaaatgctatgaagaactccatttattaagttttgccgctagtgtattaattcaaaaagccaccaacactcgccaaattgtaaggatgctggttttactatcctttttcagtgccatgttgttaaccaacgatgtcgcgattattaccttactaccacttttatttattatcagcgaaaaagcacacctaaaattggttatccctactattttaattaccatggcagctaatttaggaagtatgttgactcctatgggtaatccgcaaaatctctttattctaaactactatcatttgagcattatccagatgttgacaatggctctagcaatcagtttaaccagtcttttatttttagctagttgcttgcttttagtccctaaaaccccacttcagggtgtgactattaacgttcctgcaattaatcttaaacaaaccatcattgctgggttggttaccgtgatcgtcttgttaggagtcttctccatcttgcctcttgaggttatgctcattagtgcaattggtttaggtctgttaattaatcataacgtgttcgataaagtagattatggcttattaatcaccttcctgttcttttttatggcagcgggtaatctaagccgctatccgatcctcacacagaccctgcatcaattactacaatccagtacttcaatctatcttagttcaatttttagtagtcaaattattagtaacgtacctgccaccattctcctttccaagttcactaatgacgtttatcctctctttttgggcgttaatattggtggattaggaactctagtggcttcactagctaatttgttagcctacaaacaatttcgtattcgtcactcagagcctttcatgttacgtttttcaattttaaatttggtcggtttggtacttttaggccttgtcggttgggtattaattgtcttttttgaataaataaaaaacctcaaaatttataaattttgaggttttattttactttttttgatgtctaccaatgctagttggacgtttttgacgtcgttttttccaaataaaatagccgccaactagtagaatcaaaactactaagaaagtcatcatcccaccatggctatttcgatattcaatatctgaaccactatttgaatcagatttaattgtagtaataatccgactttttttagctttatgaactttttcttccgaactgctcttactgctgctcgatgaagaatcttcttcgtccgtgtcatcactatcatcgctattataattatcataagaattagttgctctattaggtttaacgtagtaataataagtactttgcttactacttactcgtgaactagccttagatgtactatcagatttggcactagactcgctattagtttgcgaattcgctttatcatggttgctattagttgacactgatgaactagcttggtgactcgccgaggtgcttgtattagaattggtggctccactattattcggtttagttgatgttgaagaattattagttgctggtttagaactactagttactggtgcagaacttgactgcgtagcaactgccggctgatttttttcaggcatgaccttactcccccgctgtaacttaaaaattaaatttctgaaaaattcatattactattttagcatatttataatccgagaaacctcaaccggtactatattttatagttcggttaacaaaaaatgaattgatatatttttacaatattttttagcttagtttaacctttaaggtttggtctgatataatttaatacagtgactacttatgaaaaggaaattattatgaacgaatataaagatttacaagatcgtcaagcccacattcgaaacttctcaattgtggcccatatagatcatggaaaatccacgttagccgaccgaattcttgaactaacagaaacggttgctaagcgcgatatgcaaaatcaattactggataccatggatcttgaacgtgaacgtggaattactatcaaattaaatgccgttgaattacactatacagcaaatgatggtgaaaaatatattttccatttaatcgataccccaggacacgtagacttctcctatgaagtatctcgtagcttggccgcctgtgaaggcgccgtcttagtggtcgatgcagctcaaggagtggaagcacaaactttggctaacgtttatcttgctatcgatgatgatttggaaattgtaccagttattaataaaattgacttacctgctgcagatcctgaacgggttaaaaatgaaatcgaaaatgtagttggcttagacgccagcgacgccgtgatggctagtgccaaacaaggcatcggaattcccgaattactagaacaaatcgttgaaaaaatcccggctccagatggtgacctagatgctcccttacaggcattaattttcgactcgaaatacgatgattatcgtggagttgttttgagtgttcgtttatttgaagggatggttaaacctggcgataagattaagttgatgaatagcggttcagtttacgaggttaacgaagtgggtgttaactctcctgatcctttgaagcgtgactttttaatggctggggatgtcggttacttaacggccagcattaaggacatcaaagatactcgtgttggtgatacagttacattggtcaagaatcctgcggcgcagcctttagaaggttatcgtgaaatgagtccaatggtttattctggtctatatcctaccgataatgctaaatataatgacttacgtgaagcacttgaaaaactacaactaaatgatgccgccttggaatttgaacctgaatcttcgcaagccttaggttttggtttccgttgcggattcttaggtctacttcacatggacgtggttcaagaacgattagaacgagaattcaacctcgacttaatcacgacggcaccatcagttacctaccgcgtcgaaatgacggatgggtctgaaaagattgttgaaaatccttctgaaatgcctgatgcttctagcattaaaaatattaaagagccttacgtaaatgctagtattatggtccctaatgaatatgtcggtgctgtaatggaattatcgcaattccgtcggggaattttcgatacaatggattacatcgatgaaaaccgagtgaacgttaagtatgcccttcccctttcagaaattatctttgatttctttgataagttgaagtctagcactcgtggttatgcttcgctcgattatgaactcggtgaatataaagttagcgacctggttaagattgatatcttattgaatggcgaacgagtggatgctttgagtttcatctctcatcgtgacttcgcgcaacaacgtggtaacgaaattaccgctagtctgaaagaaatcatccctcgtcgaaactttgaaattccagtccaagctgcaattggaaataaaatcattgctcgtaccaacattcgagcttatcgtaaagatgttacttccaagattcacaccggtgatcctgaccgtcgtgctaaattgctggataaacaaaagcgtggtaagaaacgaatgaaatccgttggtaaagttgaagttcctcaagaagccttcatgaccgttttgaaaactgatactgagggaaagggcggtaaataaggattattgagtttgaaaaaatgccataaatgttaatttttctgcgaatttcctgcataactcattttttagatgttttcgcagaaaataaatataaaacaaaaaagcctatctaatcattaatttgactagataggcttttattttgtaatcgattatttttcctacacctgtagtttaagtgcttttgaatcagctactatacaaacataccttatttttatactgctttcgtttacattctaaggttgttcttttacttgatgttttgagcataaaaaagagcggtctagcgtcgtgttcaggacggttttaaattattttttcgttttaaaacttttataaacttactctactatctgttgccttcattatacattttcacaattttaaattgactatcctgttctcagaaaatatcaaaccaagaactgataataagcctgctagaacttgccacgaagttgggcctcgtggaggttttgtttccagagttcgtatatgttcgaaagtgcgatcgattgccacccactccgaaacctgaaaataaatgatcgaagtgacaactttaaattacgcggtactctcgaagttaattcgaggatatttttatttttcttctagaaaaacaatatgttcttctaaaagaatctatttgtaaccaagactcgacatataatttactatcttcgtaatatttattaatgtttaattatcattagtttctcctaaaacaatcattacgtaacttagtttgttttttgttaaataaccaatcaggattgttctctcgttgcgtattccctttacattcctcttcatttttgtaagcctcttcattgttgacctaagtacaatacgtcatctattacatttttacttatttcatgtatactctagttaaagaaggtgttcacaatcaattactataatgttttactgcatactataatcgaaaattctaatacgagacgacctactattgtagatccttctaaaattcgccaacactctaatttagataatcaaacatttgttgaagctttagtttcgcttgaaaaacttggatatattgagctatgttacagaaataaaaaattagtcggtatttttattactactttagttccaattaaataaatttcttggtaataaccttttttactaaacatttttatcttttcttgtataatatctatttgaggaggtgcatcaaaaatgaagataaatactccgaacgagttgcctcgagtagatattatcgatagatctaaaaatcgtttatacgctaggcatgaatattcaaacggattaatattagtttcagaaataacgcccggtaatttaaaagtatcatcaaactataaacttttaaaagaatccgatggtacatatagtcctgactttgattcaccaaacttcgatttttacgaatgtcctcgtgtaatctaagacaataataatcatttaaaacaacgtaattgatacggtgtttttttaatctctgactaaatcaactaaatcctttaaatatgagtagtaaaaatagttgaagtgaatgctaataactgttacgagtagtccaatataaagtaatacttttccactctggcgatttgcaacggttcgattccgttagtggaattaaaaatttatctctataaaaatctaatttaaaaaaaccgatatctgaatatattgtaaaatttataaagtcttacttataccccaaaatagtatttctaattaaatccttcaccgtattttctaaacattttaaatcttagcttaatactgtccctcaataataatcgtttaatcccgctaacattatgaatatatgtttcaaaacatattattatgtttaaataaacaatcatgatatatttcttcctgtactatgttgttttatataatgtaacttcgtttttcacttaagaaagaggtgtctttatgtttaaacatacaagaaaactgcaatacaatgccaaaccaaatcatccagacccaatcatggccagacgcttacaggaggcgcttggtggacaatggggggaaactacagggatgatgtcatatctttcgcaaggttgggcatcaactggtgatgaaaaatataaagatttattattagatactggtacagaagagatagctcatgttgaaatgatttcaacaatgattggatatttacttgaagaagcaccatttagtgctgaagatttaaaaagagatccatcattagcagtaaccatggcaggtatggacccagaacacgctctagttcatggtttaaatgctagcctaaataatcccaatggctcagcatggaatgcagactatgtaacatcaagtggtaatttagttgctgatatgcgatttaatgtcgtcagagaatcagaggctaggttacaagtcagccgactctattctatgactgaagatgaaggtattcgtgatatgttgaagttcctgttagcccgcgaaactcaacaccaacttcaatttatgaaggcacaagaagaacttgaagagaagtatggagtcatcgtgcctggtgatatgaaagacattgaacatagtgaatttagtcatgttctgatgaatttttcagatggtgatggttcaaaagcttttgagggacaaatcgcaagagacggagaaaaattcacatatcaagaaaatcctgaagctatgagtagcatcccacatattaaacctgctgaccccaaattacacaatgatcaagggtaaataattaaaattttaataagctagtaccttaaaatttatgtccaggaggaaatataaattttaaggtactttttaatttgctctaacaattaatcattcataatttttatccaaataaaaaggacgattctatttagaatcatcctcaaaatattatataaaatagctaattacttatgtgtagcttttagaatccaagaaactatagctactagaataacagcgccaataattgatggtattaaagccataccagctaatgaaggtccccaagtacccaataagctttgtcctagccaagaaccaaccaaaccagcaacaatattgccaatccaaccagcaggcatgtctttacttgtaagagccccggcaataacaccaataatagcacctacaatcaatgtccaaataagtcccatctgttcacgcctccttccctaactaagtaaaattaatgttatcaaagctaaataatataaacaagtaaaaggccttatgccttataactttcattttataacaataaaagctggatgtttgtcatttaagtttctttttgttactaacggtgttaaagctgttcaatatttttctatctcatattagtaatttaagtaagttttaccattggaattggatcatttacacagccgcctttaattaaattaaggtctttattactttgatttaatttatttttgtttcctttactttgtggattaatgacaacattaatctcggtctcaatttcatcgactaaccaatatagagtgggtcttggcgcttttcttcttttagtcgcctctaaatacgtggtctgaatacgtgagcttgtcaaaaccttagccgagttgaacagttcctcatcaaaggtcccgtaagcaaccaagcggttaactacctgctctaccaatttactattaactccatcaattcgatttgcaaggctatttttaacaagtggtgtccactccaaaaaatatccccttttataaatcgctgaaaagataaaaatcgtggttaaaactcctttagctccaaattctcccataatagcttccgttttttcatttacattaaaatcaacgtcaaatggaaaataatctaagcccgcttttgttggtctggccattaaggcacctcctatgattaaaaagatgtactcatagttagtaacgttttaaaagctaaaatgtaaactaaaaatatactttttaacaaaaaaactttccaactaaagttgaaaagctttaaattattttgtgatccagccgccatcaacagggataattgttccctgtaagtaactcgccccattactagctaaaaatgtagcaactctggcaacttcttcagctccagcccagcgttttataggcacttctttagcgacagacttagccatctccccaccatttgcaaaatcttttgcattcatcggtgtatcaatacatcctggagcaatgccattcactcgaattcctcgctcagccaaatctagtgctaattgtttagtaaatccaataacggcatgttttgacgttgtgtaagctataccaccaccgccagcaaccattccagcaattgaagccatattaacaataacgctaccttcagctaacagcggtaaaatctttttagttacattaaacattgttgtaacatttgtagccagaattttctgccataaattgatcgaagtagtttcaattggctgataatcgtcaagtaccccagctgtatttaataaaatgtctactttacttatcttatcaattaccatatctaactgtttttcatcagtcaaatccacttggtaataaccaaaattggtcgtatatattacttttaattgctgcatttgatctacattgcaatcgagtccgattacttttgcgccttgacccaaaaattcgcgagcttgagcaagcccaatgccagaattagctcctgtaagtaaaacatacttattctttaactcaggataattagccaattaatccacaaccttccaatcgtctgccaacacgtcgcaaacggtaggtgcgaagctagaatagccttcgctagtcgttttaattaacatataaggagttatgggaatattattaaatttttgatctttgactactaagataaattcttcatcgccatcccactgttcacgaattgctttaccattattttttaaaataggtaatattttttcaaaagtcatttattcaacctcttttttatttatataagtcaactttagtagaaattaagtagattaaaaacgcgcctattaccattgaggcaatttcacccgcagccaatatccaataagtcggaaacatgggaagattgctgtataagtgcatttctaagtctaccagtaacatccccggtaactggcaaattgtcgcaatggtaaatttaccaaccaatgacgtaactttgcgtgtgcaaaagtacgttagcgttgttccaattagggttccagccgtaccaaaaagcatatcaatgggccctaatggactaaatacattcacaatcaagacccctaacgtaactgcaaaaatatagcgtttgttaaacgccgccaaatggttaaacatttctgaaagtcgcagttgaactacgccaaaactgataggtgctagtgcaagggtaatggccacgtaaagagccgctatgatggccgtagcggaaatatttcgattaatcttatgcatatgtaactctcctagttttagtttgaggcgggaggatatttcgaaccaccgtgtgtgttggtatcagataaaatttaatatcaacacctttaatcttaacttttagttgaaagaatgtcatctttagttttatttttgatttcactaccctaagcaaaatattatattctctcctctacttttggtaagctaaccttaataagataggtttcacaaaatataagggagggatttttatgcaaaccaaaagtaaatggattcaattaattattgcggtagttggagtagaactaatcggctcattatctggattattagctggtgacatcaaagccatctataatagctttactttgccaccattctcaccaccagatcgtttgtttggtatcgtgtggccaattttatacttaatgattggtatcgttggctacctaattttcacagttagaagtaactaccgcaaaacaaacctaacattatttattgcccaacttttcttgaattttatttggagtattgtatttttcaacgcaagtagtcgttggaccggactattaatcattcttgtattagacgcactagtattcttttgtatcaaggaattttataagagtagtaaattggcagcctacttaatgatcccgtatttcctttggattttatttgctacttacctaaccttaggaacagccatccttaactaaccttctgttattgcatcatttgattgtaaaattattaatttacttgtaagcgtatttttaggtatattcaattaactttgctagaattaagttgttccaaaaataagagactaaaggaggattcaaccatgaaaacactagatgttatcgcacttgttctattgattgtcggtggcttaaactggttattagttggtattttccaatttgatttagtagctacactttttggaggtcaagcagcaatcatttctaggattgtatatgttttagttggtattagtgccatctactgtcttaaattttttggtttgattagtgctcaaccagaaaaaaagaatgataataactattaaaaaaaacgctatagatggatgagtaatctacatactcaccttgtatagcgttttttagactcaaaaaaggcgtgcaagaataaaaatcttgcgcgccttttttctaattcataaacttatcaaagaaaccactcttaccatgaccagaaggttcttcaccactagctttagcaaattgtttcaaggcttccttttgtccgctgttaagcttcttaggtacagtgaccttaactttaacatgttggtccccagttccattaccacgtaaacgtggggctcccttgcctttcaaacggaagttagttcccgtttgagtaccagctggaacctttaatttaaccttaccatgtacggttggtacttcaatttcgtcacccaaagctgcttgaacaaatgaaatcgtttggttgtaataaatttctgaaccatctcgttcatacatatcgcttggttgaacttggaaaataatgtataagtccccataagggcctccattaaatccagcttctccttgaccttggagacgcatttgttgtccatcttcaaccccagcaggaaccgataccttaacttcgtgttgttgagaagtatgacctgtaccaccacaagtaggacatttttctttaatttccttacccgtaccattacatacatcacaagtttgttggcgaaccattctaccaagtggtgtattttgggttacttgaatcgtacccgtaccattacacttatgacaagttacgggagaagtaccttctttagcaccagatccaccacaagttttacatagggcttcacgagagtacttgatggtcgtcttcttaccaaagatagcttcctcaaatttaaggctcatttggtattgcaaatcttctccctggcgtggttgatttggtgattggcgttgtccaccaccaaagaatgaaccaaagatatcttcgaatccaccaccaaagtcactaaaaccaccttggccgccaaatccaccgccaccaaagccagcattcggatcagctgaaccaaattgatcatattgagcacgtttttgagagtcacctaagacttcatacgcctcattgacgtctttaaacttctgttcggcatcaggtgctttattgatatctggatgatactttttagaaagcttacgataggccttcttaatttcatcatcagacgcatccttactaacgcctagaatgtcataataatctttatttgcagccatattcatcctccatgatttctattagcttatcttaacagataatcatgcaaaaaggtcaaagtcagtgactttgacctttttacgattactggttatttatttgttatccttgtccggatcaacttcttcaaaatcaccattgactgtattgtcatcatcagtcttagcgtcaccagcgttggcttgagctccatcagcagcttgaccttgagcttcttgagcttgttggtaaagctttacagatagatcttgaacaatcttgctcaaatcatctttcttagctttcatttcgtcaagattgttatctttttgagccttttcaagagcttctttagcatctttagccttcttgatttcatcttcagaaactttaccttcaaggtctttcaaagtcttatccgttgtaaagattaattgatcaacttcgttacgaaggtcaacttcttctttacgtttcttgtcggcttcttcgttttctttagcttccttcatcatgcgatcaatttcttcatcacttagacccgatgaactcttgattgtaatcttttgttccttaccagtacccttatcagttgcagaaacgtttacgataccattcttatcaatatcaaacttaacttcgatttgtggaattccacgaggagcagctggaatatcagtaagttggaaacgaccaagtgtcttgttatcagcagccattggacgttcaccttgaagtacatggatatctacagctggttggttatcagcagctgttgagaatacttgtgacttacttgttgggattgttgtattacgatcgattaacttagtgaatacaccacccattgtttcgataccaagtgaaagtggagtaacgtcaagtaaaacaacgtccttaacatcaccagtaagcacaccaccttgaacagcagcacctaaagctacggcttcatcagggttgattgagtggttaggttccttacctgtccagttcttaacggcttcttgaacggcaggaatacgtgttgaaccaccatttaagataacttcgtcaatttcagaagctgaaagtccagcatctttaagcgcattttcaactggagccttagtacgttccactaggtcagcagttaattgatcaaattgcgcacgtgtcaaagtcttttcaagatgtaatggtccggcttcgccagctgaaataaatggtagactgatttgagcttcgctaacacctgaaaggtccttcttagctttttcagcggcgtccttcaaacgttgaagagccatcttatcttgtgataagtctacaccattgtctttcttgaattcatcaactaaccagtcgatgatcttttgatcaaagtcgtcaccaccaaggtgtgtatcaccgtttgttgaaagaacttggaatacgccatcccctaattcaagaacggaaacatcaaaagtaccaccacctaaatcataaacgagaatcttttcatccttaccgttttgatctagtccgtaagctaatgaagatgcagtaggttcgttgataatacgtttaacatccaagccagcaatcttaccagcgtcctttgtagcttgacgttgtgaatcatcaaagtaagcaggtactgtgataacagctttatctacttcttcaccaaggtaatcttcagcaaatttcttgatataacttaaaatcattgctgaaacttcttgtggtgtataagacttgccatcaacggttactttatagccagcttcaccgatgtgacgtttgattgaagcaattgtatcagggttagtgattgcttgacgcttagcaacttccccaacttgagtttcaccattcttaaaagcaacaactgatggagttgtacgtgctccttcagggtttgtgataatttttggtttgtcaccgtccatgacagcaactgcagagtttgtagtacctaaatcaataccaataattttattacttgccattgtttaaaatccctcttcctcttttttattgagctacgattaccattgctggtcgtaacactcgatcttttaaaatatatcctttttgtaatacttgaacaactgtatcggctggatgatcatcatcagctggcaccgtctgaacggcttgatgcatattaggatcaaaagcttgtccttcagcttcaatttcagcaacatgattttccttcaaagcctttaacaaatcggtttgaaccatcttgaccccttttaggagttgttccgaagcagactcaactgctagagcgcgttcaagattatcaagtgctggcaaaattgcttttgcaagtttttgaccatcgtacttgattaatgatgcttgttctttttcgtttcggcgacgcatattaacaatttcagcttgagcacgaatatacttgtctgaaagttcatcgcgttcagcttccacctttttaatatcatctaaagccgttgttgcttgagtttctgtagttgaatcatcattattagttgattcaacatctgctgacccttctgttgaggtagcttcagaaacttcttcttctttgacttcttcttttttctcttttgccaattcaatcctcctaactatcatcaaggtgcttataatattcgagcattcgattagacaactggtctctaaatgtatcaagtaaacctaatgtcttcgaatactgcatactagttggaccgagaatggcaattaatcccttgcctcgactaccaacatcataagtagcagtgattaagctaaaatcctttagtaaagcattgcttaattcatcgccaatctttacatctaagtcactctgattatttccaagtaatccatcaagttgatcattctcattaaatagagtcaaaagccctctaattgaactaacatctacattcttggagaaattaaggatattcaacttccctccaatgaagtaacggtcctgtgaagactgcgcaactacattttcgaaaatatcaataattccgtcgttactatgcagataatgctcaacaattttaggaatatctgttttcaggtgataataaacttgatcaagcgtttcgccaatcaagcgatcattcataattctcaagacgcgttcgacagtctcactattcattcctcgggggatcgaaaattgctgactagtaacgtcgccattactagaaaccaaaatcaacattacttgatttccaccgagtggaaccattcgaaaaccatctaaagtcgcatctttttggtcaggttttaacgttaatgctgtataatgcgttaaatttgataacatttcagccgaagttcgaacaatgtcatctacttctctaaaatgcatccccaaccccttttgaatctgttgagcctcactttgatttaacttcttggggcttaacaaatgatctacgtaataccgatatcccatcaaagatggaattcttccagaagatgaatgcatcttttcaatcagacccatctcttctagcttagccatatcatttctaatcgttgccgaactcacttttactggaagattattcatcaacgtttttgatccgattggctgaccattctcagtatactctcggacaatctcctctaaaattaacaactcacgatctgttaacatgaaaatcacctcttttagcacttagaaagttggagtgctaagaacacttaataagataccagaggtttgtagaaatgtcaactatagtcaaatttggtcagacatctttataacttgttaaaaaattcccttgtatcagcttcatcctgatgcagttgtgcgattaaagcattaaccgaatcaaatttaatttcgcctcgtaagcgatggtaccatttaactttaacagtctctccgtagatagcttctttaaaatctaaaatattaatttcagtagtaacaggacgaccttccccaaagactacatttttgccaacggatgccattcccttataccatcggtcgcctactttgatttcaacaacatagattccgatcccaggtgtaatttgattttcattagaaactatattagcagttggaaaaccgagttctcttccacgtgcttctccatgaaccaccacgccactcgtttgaaaagcataacctagataggcattagcatcatcaatatttcctaacgataccatctcacgaatcttaccagatccaatcttatcattctttaaaatgattttaggtactttaatagcctcaaatcgtccctgagctagcgctggtaaagtatccatattcgctagctcagcaggtccaaacgtataatcaaaacctgcaactaccactttggcatttaagtctaccatatattgttgaacaaaatcttcgggatttaaactaccaaatgcagaagtgaaatcaacaacataaagtatatcaacgcctaattcgcgcattaattccgcttttcgttctacagaagttaggtagcttaacgggctaaagttacgatcctgttcaaatactaccgacgcatgatggttaaacgtcattgctgccacctttaaatgctgttctcgggccttttggcaagcttgcttaataactgcttggtgtccacgatgaacaccgtcaaagaaacctaaagctagtgctacaggttctgctggaattattttttttgaatatggatgatgtattcttactatttgcattttctatctcaccaacaacatttttttaggaatatagttttgacgatttgtatcatactgatataacgcctgaatattcccattatattttaaagctatgatttcatcagtttgcggacgattcaaaaatcctccatttttaacaatttcccattcaacatctgaaattgtaattgtattaaagttatccaaggcccgatctaaaggctgaataaccgtcgataaacgatcttcatctcgtgcttgttctaagtcggataacgtcaggcattcctcaattttgaatcccccactagccaagcgacttaaatcagacatcaccgctggtaatccaaaatgacgaccaaaatcaactgctaaagttctcacatacgtccccttgccacaactaaccttgaaataaatagtttgttgtcccttttctgcatcaaaaattgatgggcgagtttgaacaaaatcataaaccttaatttgacgctgaggacgttctaccgtctcaccagcgcgggcatattcatataacttgcgacccttaacctttactgcggaatacatgggtggaatttgaactaaagttcctgtcattgcagtcaaagtttgattaatttgttcgttcgttaatggtttatcaagttttttggtttcaactacttcaccatctagatcttccgtagtagttgagaaacctaacgtaattgaaccttgataaacttttccaaatcccattaaatagtccacaactttcgtagctctgccaacacaaattggtaaaactccgtcaacactaggatcaagggttccactatgaccaacttttttagttcttaaaatacctcgaaccttggcaacaacatcgtgacttgtcattcctcgttctttattaattggaattattccatccattttggtaacctctcattctgtacttaaaatgcactcttcatagccattttacattacttatatcgtattaaaaagatttcgtcctatttatttaggtccaaacaaaaaagagcatgccattaagcatactcttttggattaatcacgatttaatttattgagtaattgatcaattttatcaccatattgaacagattcatctctgatgaaactaagttccggtgtcttgtaaattgataggcggctacctaactctttacgaattaaaccagatgccttttcaagacccgccttggttttttgatcatctgatgctttatcagataaaatactgtaataaatttttgcttgttgtaaatcacctgtcacatcaacgccagtgattgtaactccctcaacgcgaggatcacgcacacgacgacgaaggatatcactcacttctttttcaatttcttgagacaagcgatccgaacggtattgtcgagccataatagattcctcctatctactcaactggtacttctttcatgcggtatgcttcgataacatcaccaattttgatatcattgtaattttcaaccgttaaaccaagttcaaatcctcgtttaacttctttaacatcatccttgaaacgtttaagactacctagtttaccttcatagataactacaccatcacgaatcaaacgtactccagaatcacgtgtaataaatccttcagttacaaaaccaccagcaattgtacccacacgagaaaccttgtaagtttcgcgaatgtcaacttgaccaataatttcttcttcgtaaactggttcaagcattcccttcattgctgattcaacttcatcgattgcgttatagataacacgatggagacgaatatcaacatcttcagagtcagccatttgtttagcttgagctgttgggcgaacattgaaaccaatgataatcgcattacttgcagctgcaagggtaacgtcactttcgttaatagctccaacggccttatgaatgatattaactcgaacaccctcaacttcaatcttttgtaaactatcagctaaagcttctacagagccttgaacatcagccttgataatgatgtcaaccttcttcatttcgccttctttaagggaatcaaagagattatccaaagtaacatggttgctacgtttacgttcttccatttgagcacgtttagcacgttcttcaccagctgcacgagctgatttttcgtcatcaaagactacgaaacgatcaccggcttctggaacaccatttaaaccagtaatttctactggtgttgatggagtagcttctttcactcgacgaccatgttcgttaaccattgttcgaatccgtccaaaggtgttaccaataacaattggatcaccaacgtgcattgtaccttgttgaactaagattgttgcaatagaacctttaccaggatccaattgagcttcaattactgatccagcagcattttgatctgggttagctttaagttctagaacttctgcttgaagtaaaatcatatcaagtaattcatcgatattttgacctaatttagctgaaatttcaacgaaaattgtgtctccaccccatgattcaggaataagaccatattcagtcaattgttccataacatggttaggatttgctccttgcttatcaatcttgttaacggcgacgataattggaacattagcagccttagcatggttgatagcttcaatagtttgcggcattacaccgtcatcagcagcgacaactaagattgtaatatccgtaacatcagcaccacgagcacgcatttcagtaaaggccgcatgaccaggagtatcaaggaaagtaatcaacttatcatcatgcttaagttggtaagcaccgattccttgagtaataccaccggcttctccttcagtgatatgactatgacgaagtttatcaagtaaggttgtcttaccatggtcaacgtgtcccatgatagtaacaactggagggcgtgatacaaggttagttgtattcttttcttcgtcttcaaaaatcttatcaatatctgaaatatcaacttcaactttttgttgagcttcgattccataatcggctgctagaagttccactgtatcattatcaagtgattgattttggttaaccattacacccatcatgaacaatttcttgataatttctgctggttcacgatgaatcttcttagcaatctctgctacattgataccttcgctgtattctaatacatctggcaatggacgttccttacgaacagtaacaactttgttagttgtttccttcatccgcccatcgcgtttagcttttctatttctctttttgttcttacggttttctttattaaagggacggttttgattatttccaaaacggttcccacccctagaattgttgttacgtccgctgaaacgatcttgcttcttttcaccactattattagctgtcgtagctgctggagcagctggtctagttgtattgttagttgggcgattattagtcgtctgattagtattatttggacgacttggacgattttcattgttacgattgttattgtttggacgattattattattcgtacgatttacattgttaccgttacgattattgttgtttggacgattttggttattacgaccttcccgacgttgttcacccggcttagcgctattcgtgcgttgacgattagcttggggcttctcgttagcaatttcgcggttagcttgagcagccatacgggcagcctctgctactgaagcacgaattcgatcttgtttttcatcgcgcttaggttggttaggacgattaccattacgattgttgtttggacgattttggttattgtttggacgaccatttgtattattacggttttggttgccatttttgttattgttattgtttcttgtagtactttcattatttgatgatttcaatctttgaatacccttcgttccatcagctgctggatggtcgcttttcttaaccacagttttaccagttttgcttgaacggaatttaggtgtccgtttttcttccggtttgtttgtagtagtattttttttgaaagcattgcgtaaatgcttttcagaagcatcgtctagcgtcgacatatggttttttacatcaagaccatcggcctgcgccttttcaataatatctttactcgaaacgttgatttctttggctaattcataaattctttttttgcccatcgtttcacgctcctattcatttattttctttagtaacccctttgcaaaaccattattttcagtcgccactaccgatctttcctgcccaattgctttggaaagatcttctttagttcccaaaatagtgaatggaacttcgtaaaaatgacacttatcaataatttttttctttgaggactcgccaatatcttctgttaccagaacgaatttggctttctgactacgaattgaactgagtactagttcttgaccagtaaccaagttacctgaacggcgcatcaatccgagatatttactaatattttctttaatcatttacttaccaaataactcttttcgtgcttgctgatgatcaacataagcaattaagtcatcgtagaactggtcgtcaactttaattttaaacgcttgatcaaaagttcgcttcttttttgcctttttagcaatttcgacatctaatccaatataagcgcctcgtcctgcagctttacccgtcggatcaatagctacttcgttttccttatttttgacaactcgcacgagttcctttttaggaaacatttgatttgtcacaatgtctttacgcattggtatttttctggttttcatcaagaacacacctccaatggtttattcagcggtttcttctgtactttcttcagaatcttcttcttcagcatattctgatgcatctgtttccgatttgatgtcaatcttgaagttaacaagtttagcagctaaacgcgcattttgtccacgacgaccaattgctaatgaaagttggtaatctggaacgattaccatgcagtaattttcatcttcttcattaaataatacgtcaataacttcagaaggtttcaaagcattagctatatattctgctgggtcctctttccattcaatgatatccatgttttcaccatgaagttcattgacaatcgtttgaacacgttggcccttagcacccacacatgtcccaactgcatcaatatcaggatcattagaacgtaccgcaattttagcacgatcaccagcttcacgagcaatcgacataatctcgaccgttccatcataaacttcaggaacttcttgttcaaagagccgtttcaaaagtcccgaatccgttcttgaagcaaaaatttgaggtcccttaccgttattttccaccttcgtaatataaactttaatatgatcatgaggttcatattgttcacctgggatttggtctgacttagccatcacagcttcgaccccacccaagtcaacatatacgtaacgattatcacggtgtgatacttcgcctgtaacaatttcatcttcgtattgaccatacttttcgtaaattacaccacgttcagcttcgcgaacccgttgcataataacttgtttagcagtttgagctgcaattcggccaaagtttttaggagtaacttcaaatctgatttcatcatctaattcgtatgctcgattgatcatcaaggcgtcagctaaactaacttccaattgatcatcttcaacttcttcaacaacttttttaacggcgtaaacatgaatatcacctttacgatcattaaattctacttcaacgttttgagcctgtccgtaattacgcttgaatgccgaaactaatgcagcttcaagtgcttcaacgataacttcttttttgattcccttttctttttctaagatatcaagagcggtaatcatttctttactcattttaaactctcctctaaatcttgattgctaatctagcaaatgcaacctgatcatacgttactttaagttctttatgtctagtcttatctaaatagtccaaaacaatttcatcattttcaaagcttttaaggtaaccttcgaaaactttttgcttattaatcgatgcatatagtgagatatggatatattcaccaattgatctcgtaagatcttccttcgtttttaaaggtcgttcagcccctggagaagacacttctaagaaataagcttgtggaattggatctggatcttgtgcgtccaaaatttcacttagctcatcactgaccatggcacattcttcgatgttaatgccaccaactttgtcaatatagactcttaggaaccaaccttgaccttcttttacaaattcaacttcaacaagttcaaaattatggcgatcagtaattggttggactaattctgtcaccttttcaataacattgttactcaaacttgaacctccagaattatattttgccaataaaaagagtgagcatcgctgctcactcaattaacgagtatcaaattactactctgaatataccattatatgggcatttttgcaaatcatcagaataaactaagctgattttcatccggcaactccgataaaacgttgttctcagtcatgaaatcaattaaagtttgcgaaacatgtccccgctttgacaagtcttctttggaaaggaatggcttgtctgctcgcgcagccacgatttgtttagcaacgttcaatcctaaacctggtaaagcattaaatggtgcaattaaggacttgccttcaattaaccattcttcagcatctgatttttcaatatcaatcattttgaattcaaaaccacgttctaacatttcgttagctaattctaacacggttaggagatttttttcctttgtcgacgcatcgttacctttatcattaatttcttgcatgcgatttttgagggattctttcccgcgtgccatcgaaacaatgtcaaagtcatctgctcgtaccgtgaaatatgctgcgtaataaaccaatggataataaaccttaaagtaggcaattcgtaaggccattaaaacataggctgaagcatgcgcccgtgggaacatatatttaatctttccacaagattcaatgtaccaatcgggaacattagccgcacgcatcttatcttcatagccttctggaattccctttcccttacgcacactctccataatttggaaggaggactgtgaatctaaaccataatgaattaaatccatcataatattatcacgacaaccaataacttctttcaaagttacggtacccgccttgatcaattcttcggcattccctaaccaaacatcagtaccatgtgataatccagaaatttggagaagctctgaataactagttggatgggtttcttccaacattcctcgcacaaatcgcgtaccaaactcagggattcctaaagttcctgttttagattgaatttgattttcatcaacgcctaaaacttctgggccagagaaaattttcatcaccccggggtcatcagttggaatggtctctggatcaattcctgataaatcttgtagcttacgaatcattgttggatcatcatgtcccagaatatccattttcagaatattatcatggatagaatgaaaatcaaaatgagtcgtttcccaagcagccgtctgatcatcagcgggatattgaataggactaaaatcatatacatccatataatcaggaacaatcaaaattccagccggatgttgtccagtcgttcgtttaacaccagttgcgcccttagccaaacgttcaatttcggctccgcgcaaatgctgattggtatctctttcgtacgctttaacatatccaaatgctgttttatcagcaaccgtaccaattgtaccagctctaaacacattatctttaccaaataaaacttgcatataattatgcgcaataggttgataatctcccgagaaatttaaatcaatatcgggaaccttatctcctttgaaacctaggaaagtttcaaacggaatatcttgtccatcaccaatcatccaagttccacattccggacattctttatctggaaggtcatatccagaaccatattcacccttggtatagaagaatgaatattgacacttagggcatcgataatgaggcggtaatggattaacttctgtaattccagacattgtagcaacaaaactagaaccaactgatccacgcgacccaactaaataaccatctttattactcttatgcactaggcgctgagcaattagataaattacggagaaaccatttccaatgatactagtcaattctttatctaatcgttcttgaacaatttccggtaatacttcaccgtacaaagcatgtgcccgatccatcgaaagctgtttgattcggtcttcagcacctggcattttaggtgtatacaacttatctttaactgggctaattccgtcatctacactatcagcgattttattcgaattttcgacaacaatcttgtgtgctacttctggacccaagaaagcaaagtcttccagcatttcatcggtagttctaaaatgaacatcaggcaattctgaacgatttaaaggattagccccaccttgcgaattaattaaaattttacggtagatataatcttgcggattgagataatgaacatctcccgttgcgactactggaatatctagatcctcacctaatttaacaatattggcaatgatttcctctaacttcttattatcactaactaattcttgttcgattaatggttgataaaccggtttaggcattacttccaagtaatcatagaatttagcctttcgccgtgcatcagcatatcctttttgcatcatcgccgtaaaaacatccccgctagaacaagcagaaccgacaataatcccctcgcgtaatttttctaactcagagcgaggaattcgaggtacacgatagtaatatttaacatttgacattgatactaatttaaaaagattttttaaacctgcttgggtcttagcaattaaaatggcatgacttggccgtgcatgtttatatgcttcattttcagtcatgtgatcatttagttgatcatgatattcaatcccataacgttcttcggcatcttttaagaagagataacacaaatgtcctgtagtttctgaatcatagatagcccgatgatgatgttcgagtgctaccccaaattttttagccaaagtgtttaaacgataacctttcagagtaggatacaagaaccgcgctaacgttaaagtatcaattatgggattttttatttcttccattccatgtcggaggtaacctgtattcataaaaccaatatcaaaagttacattatgtcccacaataatagcatcttcataaaattctctaaatttggtgaaaacttctttttcagacattgaaccacgtaccatttcgtccgtgatactagtcagattaattgtagtttccgaaagaggaaaacccggatcaataaattcttcgaactgatcaattacatttccattttccattttgaccgccgatagttcaatcaccttgtcataaattgcagacaaacccgtagtttccacatcaaagattacatatttgccgcccttcaatgggcgatgttcactgttatagccaattggaactccatcatcaactagattagcttcaacaccgaaaagtgttttaataccattttttttaccagctgcatgggcttcagggaaagcttgtaatccagcgtgatctgtgactgcaaccgccggatgcccccacttagcagcttgtcctaccaaatcgctaattccgttagtagcatccatcgtactcatattagtgtgtaagtgtaattcaactcttttatcagttgctgtatcttgtcgatcagcgtggtcgacttccatgatatcgtaagcattcatcgttagatctttcataaaactatcttcttgaatacttccgcgaactctaacccacaaaccttttttaatggccgagaataattgttcatcggcctcattacgagaaaacttcttgatggtaatagacgatgtatagtccgttaccttaaagattaaaagttgacgctctgaacgaagagtcttaacttctgcgtcaaaaatatacccttcaatggccaccgaacgttcttcttgggtaatatctctcaactgaacaatattgtccttaccattaattggtttacccatttgtactttaccattaaattcaggcatcgctttatcagaagctttctttttactttcagcttttttaattgcctcagtcgctttttgaacaatggcttgatcacgtttaattttttcttcatgataagcttgcaaacgttcttgagcagtattgtcatcgattgtaggtttaattttaatcggaccaaagccaactttttgatacgtattactaagagtctgcaaaacatcgtcattgagaaagttcttagtaatttgattatctactttgacaactaattgtccatctttaaactctggaatcgacttatcacataacacttgtagaagtgatgattgaataccactattcttgataatccaatcccaataatcggttgcatgggttgcaacattatttttatttatagtatcaattgaaaaatcaatttgagctattgccccaaacgtattaaccaattgatgatgaaattcaacaaagacttgtaaaggtaaaatatcattaaactcaaaactaaacgtccaacgcttggaattggagtgcacagttaaatctttgattgaaccatcttttaattcagcattatccaacaaatcaatttgctctaataaaactctgaattgttcattttctgacaaactcactctttggtccccctgatgttactaatccattaaaaatatttgctacaaataattaaagctgggattccccagctttaattggtttatttacttttattgagcttggtttaataaaatttctaccgtgttatttagttccgcaatcttaacttcgactgcttcccctgtcttacgtaacttgacttcaacaatgccttcagaagctttcttaccaatggtaacacgaagtgggattccaattaagtctgaatccgcaaacttaactccggcacgttccttacgatcatctactaatacatcgtaacctgctttagttagttctccgttaatttggtcagcaatttccatttgttccgcattcttggcattaactggaattacatggacatcataaggagcaatattcttaggccatacaagcccattttcatccgattgttgttcagaaacagctgatagtaaacgactcaccccaattccataacaacccataattactgggattgctcgtccgttttcatctagtaccttagcatccaaagcttcagagtactttgttccaatcttgaagatatgaccaatttcgattcccttagtgaatttcaaagcacccttaccatccggagcaagttcgccttcacggacagtacgaatatcagcatattcatcaacggtaaaatcgcgttcaacattaacatttttcaaatggaaaccatcttcattagcaccaacaacgctgttaaccatttgttcaatatatttatctgctacaatctttaaattttctggtttgttttcaagtactggaccaagcgaacccacgtgcgcacctagaagttcaaaggcttcttcctccgttgcttctcgaacctcatcagcgtgcaaaagatttgtaagcttaacttcatttagttgatcattcccacgtagtaaagccaaaacaggtgcttcatcgacaattaaaaccatagttttaattaaacggttgctatccacatctagcttagcagcaacttcatcaattgaatgcgcatcatcagtagccactttagtaagttcttcttgattttcatgcatttgaagatctgtgtagacactacttgccatttctaagttagcagcataatcgctttcttctgagtaagcgattgtatcttcaccaatagaagcaatagctgaaaattctttggaatctcgaccacccattgctccggcgtcacccacgatttcacggaagttaagaccacaacgtctaaaaatgttttggtaagctttttcgaaatcacggaaactttggtctaacgtttcttcatcggcgtggaaagaataagcatctttcattaaaaattcacggccgcgtagtaatccataacgaggacgatcttcatcgcgatatttcatttggatttggtataaagaaagtggaagtttcttgtatgatttaacttcgtctcgaatcaatgtagtcatggtttcttcgtgtgttggtccaagaataaaatcacgatcatgacgattcttaaatttatagagttcttgaccatatgtttcataacggcctgattgcttccataattcagctggtaaaaccgctggagttaacatttcaacggcgtcgattgcttccatttcttcacgcacgattttttcaatcttactaatcactttataagctaatggtaagtatgcatacattccggccgaaatttgacggatgtatcctgcccgaagcatcattttatgacttaaaacttcggcatcatttggaacttcctttacagtaggaataagaatttttgattgtttcataattgaatttgaactccttaagttaatttaaaaaaagtatctttgaatatcattccaagtaactaacagcattaatatcattaaaaatccaaagccaattagcgtaatcacattttcggtttcaacttttaaaggttttcttcgaatcatttcaacgagatttaggagaatttttcctccatccaaagctggaattggtaataagttaacaatccccaagtttagggatagaaaaccaagcacatacagcactgacatgaagccttgatgggtagcttgagaggtcgtggcataaattgcaacaggaccgcctaaatcattcaaactaaagccatgtagcatctgtcctaaagcggtaaacaaactcttagccatttgccaagttccagtgaaaccatataaaactcgcttacctaaattagttgtcatggatgattgaataccaatcatacccacttttttactaccattacttgctaacttaggtgttaatgtgattttctttgtttgcttttgacgtaatacttctaaagtcgttttttgatttggacgagctgaaactgccttagatagttgactccaattatctgttttttgtccttcaactctaacaatacgatcattatttttaattcctgctttttgagcaacaccattttcaacgacttgtacttggttagtattagccggaactgctccctgcataactcccattatcgcaaaaacaacgatggccaaaacaaaattattaaatggtccagcaaaattagtaattagtcgctgccaaatcttagcagattgaaattgaacatcacgcggtgcaattcgaacttctgtcccgtcggattcgactatcgatgcatcatgatcaatttcaaaatgtttaacttcgtcttcgttaccattttcataaccttcaatgaataatttatcttgtaagtcaaaactggttacatcaactggaatgcccatcaaattttgaactttactagaagtattaataatcgtcacttgtccagtattatccgtggttaatgtaacatgttgtcccgctttcaattcatcttcttgttcatcgagtcccgccattcgaacataaccaccaatgggaagaatccgtaaagtatacgtagttccattacgcttcaaatcaacaattttaggacccatcccaattgaaaattcacgaactaaaataccggactttttagcagcaacaaaatgcccatactcatggacaacaactaaaattaaaaatacaacaataaaggtaataatcgtagttatcataaataactcctaactggcaaattttatagtaaacctaataaatatgccattggcaatactagcaatagactatcaaaacggtcaaggattcctccatgacctggtaagatacgaccagaatctttaacaccgtaataacgtttaagagaagattctattaagtctcctaactgacctgcaattgaaaggaatagcgtcattaaaattgtagctagaattccataatggattagtcccgttactgagaaaataattccaacaataactgcaactatggttccgccaatggaaccttcccaagtcttattggggctaatttgaggagcaagtttagtcttaccaatctttcttccgactaagtaggctccactgtctgtactccagacggttagtagcagatacattaacattcctaagcccaccgttcgagcttgaacaaacatgttaaatccgaatccaatgtatagcattgtcaatgttaatacaccagcatcatcgaaattgaaacgatttttactgaaaacaactctcaccatcaacgcaatggcaaaaatcaaagaaacaaatggtgtattaatttggctcggtaagtcgtgcatccatgacttaggggcaaccaagaataacgttcctaagatactaataattgcttcaggagttaccaacaaaattcgtttcataattaaaacttcactcattgccaccacggctagggccaaggctgcaatctcgattaatgttcctccaagaaagacaattggaataaaaattattaacgctactacggcagtaattactctttgcttcaaaattaattcctcactttttaattgcaccaaaacgtcgatcacgtttttgatactcttttatcatttcaataaagattttttcgtcgaaatctggccaaagtgtgtcagtaaagactaactcactatatgcaatttgccaaagtaagaagttcgaaattcgctcttctccactggtcctaatcaatacatctggattagaaagttcgcctaaaaaattagtttgtagatggttttcaataacctgctcatcaattttatccacgtccaattgtttggtattaacagcttgagcaattgactggaccatcttggtaatttcgtcccgacttccatagttaagagcaaaatttaaaatcatctttgtaccttgtgcggtgtcctcgatcgcttttcgtacagcatcttgagtcgcttggggaaggccgtcgatatctccagttactcgaacctggaccccctcttcaatcaattctggaacaaatttattgaaaaaagtaatcggtaatttcattaagaatgaaacttcatcttggggacgtttccagttttccgtcgaaaaagcgtataaggttaacacctttacgcccaacttactagcacttttagtaatagtcttaacgacttccattcctcgcttatgaccagcaacacgtggcataaatcgtttctgagcccagcgtccgttaccatccataataatggcaacatgctttggaatattttcatttaattctgtttcaagtttttgattcattttcgtcaaaaaacctccaagctaatggttattattttaccaaaaaaaagctacaaaatcattgttctgtacaaataaacggacaacgactattaaagatacgtcaaacatcttcaaaactacctaaaaacacatgatttttattgtaccataccaaattttgatactttttggttgaagttggaatttttcaataaccagtaaagcaccccaaaagttgagttttcactacaattcttggggtgctttatcaaaagttaatactagccttcaaggacttctttttccttattagctacgatttcgtctacaactttaattgctttatccgtactatcttgagtttgtttttctaaatcatggaattcatcatcattgtagtcgccatttttattagcctttttcaaagtgtccattgcatcacgacgaatattacgaactgctactttagctttttcgccttctgctttaacattcttggctaaatctttacgggtttcttcagttaattgaggaactactaaacgaattgccgagccatcattagcaggattaatccctagatctgacattaaaatagcttgttcaatgtcgttcaatacgctcttatcataaggagtaactaacaatactcgtggttccggaatggtaattgaagccatttgattaagtggagttggagctccataataatccactgagactttatcaagtaatgaagcattagcacggccagcacggattgaacctagatcacgttctaaaacattctgtgccttttgcattttttcttcagctttttggattatctcattttttgccattattcttctcctctaaccgttgttccaatattttcacctgcaacaacctttttaatgttacctgcttggtttaagttgaaaacaactaatggaatattattctccatcgaaagtgaacttgcagtagtgtccataacattaagtcctttatcaataatatccatatgtgttaattcgtcaaatttaactgcatcagggtctacgtttggatcggcagaataaataccatctacgccgtttttagccattaaaattgcttccgccccaatttcagccgctcttaaagctgaagttgtatcagttgagaagtatgggctacctgtaccagcagcaaagattactatgcgattcttttcaagatgacgaacggccttacgacgaatgtaaggttcagcgatttgacgcatttcaatggaagtttgaacgcgagttggaactcctagtgattctaggctatcttgaagtgctaaagcattcataaccgtacctagcataccaatatagtcagcttgaacacgttccattccaagctgttcaccagtttctccacgccacatgttcccaccaccaacaacgatggcaatttgtactcctaggtcatgcacgtcacgaagttcttcagcaaccttttgaattactggtggattaatacctgttcctttatctccagcaagtgcttcaccactcagcttcattattactcgcttgtatttaacttccgacatattacggcctcctatgtttaatttccttcattaattctatcataaaaatgcggcaaaccacactgttattacgtgtaaaatcctacaaaaaagcgaattaattgagctaaactcatattaattcgctttttaaatatccaaaaactctgggttttattggcccatttccttacgaacttcttcagcaaagtcaacagtttgtttttcgataccttcaccaacttcaaagcggataaatgacttaactttaccaccctttgaagcaacatatttagcaactgtttggtcaggatctttaacatattcttgatcatctaaactaatttcagccaagaacttgttcaaacgaccagtaaccatcttttcgatgatgttagctggtttgccttcaccttcagcttctttgctaagtacttcacgttcgtggtccaatacctcagcaggtacttggtcacggttaacatacttagggttgatagctgcaacgtgcatagcaacgtctttagcagtttcttcatcagcaccttcaagcaatacaagcgctgcaattttaccacccatgtgaagatatgaaccgaaatgttcgttttcacccttttctaaagtagcaaagcgacgaagagaaatcttttcaccaattacttgagttgcttcgatgatatcatcattcaaagtaccctttggtgacttcaatttaagagcagcatcaacatctgcaggtttttcaagtgcaacttgtgaagcaatttccttaactaagtcgatgaaacgatcgtttgatgcaacaaagtcagtttctgaattaacttctacaattgcagctgtgttgtcatgcatttcaacatctgcaagaccttcagcagcaacacggtcactcttcttagcagcctttgcaatacctttttcacggagaaaatcaactgctttgtccatgtcaccttctgtagcaacaagtgcttttttagcgtccatcataccaacaccgattttatcgcgtaattcttttactaatttagctgaaatacttgccatttttatggcccccttagctttttatattactaataccaatttgtgattccgtaaaaaaaggccgcgcgtaatctcaggcctaaaaggtctcaaatcacgacagcctaagtgataattattcttcgttgcttccttcttcaacagacttcttcaagtcttcaagagagtccttgcttacgccttcagcgacttcttgtgaagcttcttcttcgtcttcaccttggcgaccttcgataacagcgtcagccatcttagcagtgattaaacgaacggcacgaatagcatcatcatttgatgggataataacatcaacttgatctggatcagagtttgtgtcgaccatagctacaacaggaatattcaatttttgagcttccttgatagcaatttgttccttacgaggatcaacaacaaacaatacgtctggagtatgaggcatatcttcgataccacccaagaatttttcaagcttgtctttttgcttgttcaaaagagcaacttctttcttaggtagacgatcaaatgtaccgtcttcttccattgctttcaaatctttcaaacgcttgatacgtttttggattgtgttccagtttgtaagagttccacctaaccaacgatggttaacaaagtattgaccagcacgttttgcttcttcttcgatagcagtttgtgcttgcttctttgtaccaacaaaaagaactacaccatcatttgcagcaacatctttaacgaagttatatgcattgtcaattaatttaacagttttttgtaaatcaatgatgtaaataccattacgttcagtaaagataaatggcttcatcttagggttccagcgacgtgtttggtgtccaaaatgtacaccagcttcaagcaattgtttcatagaaataacagacatgttattttcctcctagtttttcctccttgattatctacggtttcgggactcaaactagttgagcactccgtcaacttccaatcaagtgtgtttttgacctacaggccgaatataattttaacctaactaaagtcgcatttcaagctaaatattagtcaaacttaacttcattttttgcagcacctttttcaattagtgctttattattttcaagagcaatttgtaccatatttttaactgctggcttagtataaaaagccgcatgtggtgtgatttttacattacgtctactgtataaatcattaaatacgggatcattgattgggtcattttggtgatccacatcaaaaacacctacttcgtcttcataggtatctagtgccgcaccagccaccttaccactatctaaagccttaagtaatgccttcgtgtcaatcaagctaccgcgagcaaaatttagaacaaataccccatcatgcatctgtgcgaacgcttcatcatttaacatatggtagttatcttttaaagcgggaacatgtaaggtaataacatctacttgacgataaagttcttcaagcgagtcaacatagattccttctttttcaagttctgaatttcggaaaacatcataagcaatcactttagctccaaagcctttaaagatattaatggccgcacgcccaattcttccggtaccaataactcccactgtcatttggttaagttctagagcaatatctggttcccatctgaaatcaccacgagccatcttagcatcaaattctggaattcgacgaattaaagctaggagttgggttactgaaagttctgcaatcgccattggagagtacgctggaacattggtaatcttaatattatttcgctttaaagcctcaactggaacattatcaacaccaacgttacgaagcgaaaaggcatgaatcccgaattcattcattttatcgaacaaatcatctgtataaggtttctgttgatatgcaacaactccgtcataacccttagcttgttcaatcgtgttggagtccaacaattcgctaacagcctttacttcaattttattatctttaacccattcttctaggtaaggtttttcgtcatctcgaatgccataagcaataattttcatcaaaaattctcctctcagacttggctaaataatttgttttacatactgtatcatgattcaaaaaatattacagtattcaaactattaaattagtcgttaatcgccttaactgtaccactattattttaaatttgttaatgaaataccgttctttttaagaaatttaattttactacttcgcgttcgttgcttgaactgatattctgcagacattgcgtcatgctgattatcaaacgattcaaaataaattaattgaactggtcttcgagccttagtatatttggcaccttgtcccttattatggcgttcaacgcggttaataagatttatggtatagccaccatataaagtgttatccgcacagcgtaaaacataaaaataaaatccgttagtcagtggaatttccatataataactccttaattgctttagagtattccaacccctcataaataactattggtggtaagattctagttccattaggcttaccgtctttaatcgcttcgattaaaaccatattagcttcatctcctgcgtgagaatgtgcaaattgaattcgtttaggtgccaatcgatttttaactaatttggttaaaatttcaggtagtcgatccggtctatgtaccaaaaataattttccgttcatttttaacatcttttgactcacctgaagaacttcctctaatgaagtcgttaattcatgccgagcaagtgccaaatgttcattgggatttttcttgctactaggtaaatcttcaaagtaaggtggattacaaacaatgttatctatggaatcagcattaatttttgttaacgcatctttcaacggcatgttgtaaacatcataacggtcagttaaatcgttcaactgaatactccgcattgccatctctgctaatcgtgactgaatctcaaccattgtcacatggccggcagtcttttttgaaagaaataaacccactgctccatttccagagcaaagatcgacaattttagtcttactagcctttttaacctcagcaaaattggctaataataccgcatcaagtgagaatgaaaatactgatggactttgaataatctgaatatcatcgcgatataattgatcaattcgctcgtcactttttaactcaacttgcatttaaaactccttttctttaccaatacttcataatataatcaaattaataaatatatgaaagtacaggttatcttatgttttattcatttattaaacactttgtttcttcattgatatttcttattaatgggaaacctgatgtacacaactcagaacgtttaccagaaggtagttatgtgttagtagctccccaccgcacgtggtttgatccagtgctatatgccctagctgcttatccgcaaagattttcttttatggctaaaaaggaactctttcaaaatcggtttttaagctggttaattactaaattaaatgcttttcctgttgatcgtcaaaatccgggtccttcagccattaaaaccccggttaagattttaaaaaagggagaattatcaaccattatttttccttcaggaactcgacattcccaagagcttaaaaatggtgctttcgtaattgccaaattagctaacgtccccattgtaccagctatttatcaaggaccattaacctttaaaggactatttactcgtcaaaagattcatatcaactttggtgaaccgattactattgatcgtaaaacgaaaatgaatgacgaaaacttagcaatgctagaagaagaattaaacaatgcttttgttaaacttgataatgaagttgatcctacgtttaaatacattgacatttcgaataaagaaacaaaaaaagcgtccaaataatggacgtttttttatttcttagattgattttgcatcgcagtcatcatttgatggagcttcttttgtgatggcttttgacccatctgaagcatcattgttctaagcatatcctcgttaattggggggttattcttcaaataattctccatgtaacgacgagcaaagaagaaaccaccaactgcaccaacaagcaatgcgatgattacaatcataatccaaattccagttgacatttacaatcctccttaccaacgacttacctattcattttacacaaaaacggctaaaaacaaaagccccgttctaatcgtcacgtaagcccttttttcgttgaacttcttttaccttttcaggtgtgacttctttgccttctttatcaaaaatttgcatcatttcaacttgacttttgaaactctctcggaacttcttcaaatatttttgacgcagatcttttcgctcgataatctctaagtcactaagcccttcttcttttgcttttttagcaagttcattgattctcttaattaatttttgcatttcttgatcggccataataaatccctccgttattagtagtttaatcatactatggaaagctcttaatttcaatttttaaggcgaacgtttgtttgagtattaggcttttttatgataaaataacaacaaatatttatgaggtgaaaaaatggcaaaaaatatcagcactaagcaactcagcgttctggaatatatttataaaacagttaacgctcaaggatatccacctacagtgcgtgaaattggtagtgccattggactatcatctacttccactgttcatggacacattgatcgtttacaaaaaaacggctttttagaaaaggatcctactaagccccgagctctagaggtaacaaaattaggtttagacgctttaggagtacaagataaaaatcctactattcccttactgggagtagttactgccggtgaaccaattttggctgttgaagaagctacagatttcttccctgttcctccagagtacgaaaatgatagtagtaatttgttcatgcttaccatccgaggagaaagtatgattaatgccggtattttatctggtgatcaagttattgttagaaaacaatctacagccgacaatggcaccattgtaattgctatgactgatgaaaatgaagcaacttgcaaacgattctatcgagaatccgatcacattcgacttcaaccagaaaatgatacgatggccccaattattttggacaacgtgactatcctcggtaaagttgttggtttatttagagataacatctactagatgtgactttcctattgatttattatgtttttcaaagcatactattgttaatgcgataaatcattttggagggttactatgctttacgttttagttttagcatcaattacattattacttggattttttcaattttattcatcaattaggaaccgaggctccatttttttaagctcacttttagtgattatcccccttgctgttgttattttctcagcaagaaatgtgatggaaacttcacataaaagttctggctctaagaccaactcaactttaattgctagtaaaaaatcaagcttgaaggacgataagttggaaatgattaaaagcgaaagtgttgcctcttcatctaaggcccaacaggtgcaacaagtccaggctagtcttactaaatcttttaaatcgtttggtactgttacatatgatccatctgccaaaacatttagtgtttcagcaaccgataaagacactaaaaaagttttcaatcagttgatcgaaaatcctgaccaaatgagtaatagtaattttaaagatatccaagataaatttgttgaggtttcaaaatccctcaaaaaagaacttggtacgggatatgccgttcaattaaatcaacctgacaaaaataaagcgatgattatcgcgaaagacggtaaaattgtttacagcctcttctcataaaaaatggcaacttaggtttaaacccaagttgctatttttttaatttactttttcataaatccgttgttgttgttgttgtcccttcaaaacaaatggtgcaggatcgttttcaaattcagttctgtagtccgctgtttgaggtttcataaaactacgatagatttgttcatattcagccactgagactgaagttctttgatccaaaaatgcaatttcttcatctgtaacatacttttcatatccttcaacgactttagcagaataaaactcaccttctgcaccagaaccataactaaacaagccaatttggtcgcctgcttttaaattgcgggcatgtaataatgacaacagactcagatacaatgaacctgtatataaatttcctacctcacgattcaaataacgactctcctcaaaatgttctaataaacgttcttttaaatcatcattatctaggtcttcaattacgcttcttaaagctttaagccccatcttagtgtaaggtaaatgaaaaacaagagcggtaaatttatcaatctcttcgcccgttttttcgaggtaattttcgaaggtttctttgaagaaattaataaattcggctgatgaatacttaccatcaactaacgcttcactacgatttaatggacgccaaaaatccataatatccttagttaaatgggcactttgcgttccaatttcaaggagatgaggattagcgctcataattatcgcgattgctcctccaccttgagttttttctcctaatgtaccaattccatagcgagcaatatccgatcctactagtaaaactcgactttccgggtgtaaagcaatatgccccattgccatttgaattccggcagttaaaccaaaacaagcttgctttagctcaacaccactcgctgatgagttaattcctaataatgactgtaagtagattgctcctgatttagaattatctacaccagattcagtaccgaacaaaatcaaatcaattttttctttttcgttatcatctactatttttaatgctgcattagctgctagtgttactgaatcttgtgaatttcggattacagcttgttttgattgtccaataccaatcaagtatttattcggatcttcgttacgagcctttgcaagatcctccatcggtaaatataaatcactcgtaaaaaagctcatcttatcaattccaattttcaaaaccaatcctccaaagcttaatcctaaattttttatctattaaattttagcagacccctatctgtttatcaaagttcagcttatttcttaggtaaaccttagcaatatcttttcctttaaaatattaaaagctttagaactttagctttctgaattttttctagccccgtttacggcggaatttaattataaaattaatcgttaaaaccattagaaaaacaaatcctactgtaactgatgccctcgtgtctggattgatgaacataaaaactacaatcaaaagtaacgagataatcgctaagtaattactcatgggataaagcggcattacaaaaggatgattttgaattatttctgggttagcacggcgaaagcgtaattcagaaagtaagataacaaaccatggaaccatccccggcaacacactcgaactatatatcagcacaaataggttaacagctcctcctttgaatgaagataagaagatatttaagataatccctaacaaaattccaaaagatatggtcaagattgctacagatggaactcgatgactggataatttaccaaaaatcttaggtacctttccttcttgagatagtttatacaacattcgactagcactataaattccagaattggttcctgacattgccgcagttaaaacaacaaaattgataattccagccgctccggtaattcctacttttgaaaaagtttccacaaacggagaacctaccgtagccaattgattccaaggaaaaatagctacgataacaaagattgctcctaaataaaaaattaaaattcgccaaacaattgattttaccgaagcaacaatggcctttttagggttagctgcttcaccagcagtgataccaagtaactcaattccttggtaagagcctacaacgattgataacgcaaacaagaatcctttaactccacctgtgaaaaagcccccgtgagcccaaagattgctcaatcctacagggcgccaatgattacctaagcccatgaaaatcactaaaacaccaataataatcattaaaataatcgttagcactttaattaaagcaaaatagaattcaatcgctccgtatgctttagtagaaaccaagttagcaagcgttaaagtagcaattaccaccacactagaaacccaccctggtaaatttggccaccagtaattcaaatattgactaactgcaaccacttcgctaatcccaactacaataaattggaagatattgctccacatggttaaatatcctgctaaggggtgaatatagttggttgcataatcagcaaaggaaccggtgcttgggtttacatataaaatctcccctaaagcacgcataactaggtacaatattaaccccgcaaagccatatgctagcaacactgatggtcccgtccacttaattgtcgatgaggatcccatgaataatcccacaccaatggttcctcctaatgcaatcatttgcatttggtttgatgtaagtgatcgttttaactgcggtaaatcttccttcattgttcttcctcctcaaaatataaaaaaccaccgaatcagtatcaatgctagtaggcactgaattctgattgggtggttttgtttgttaaccaaattttaattggaaagcacctcaaaacactcaaccagacaggatggtggttgaggtagtggttgttacattaacattagcaaaatatttaacttgatgactcatataacaacctccctttcacttattattagaataatatcatttaattttaataaacgcaattacatctagtcaatttctcaaaaaatctatctatatctgacaatttgaggatacaaaaaaagattaaggtaaccaccttaatctttttatttagcttaaattaaatgtacgcctttatcaacgtaaataacatcaccggttacaccagttgccatatcactaacaaggaatgcggcgacatttccaacttcactagtacttacattttcaccatcgactgtacggctttgagattctttaagcaagtcacgatgatgcttgatacctgtaacagcaagtgtcttaattgcaccagctgaaatagcattaactcgaatatgacggtcacctaaatcacttgccaagtagcgtacgctggattcaagtgaagctttagcaattcccatcatgttgtagttaggaattgcacgagttgagccgaagtatgtaagcgtcacaatactacctttttcgttcatgatttccgcaccatagcgtgaaacagcaatcaatgagtaagcactaacatcttgagctagattgtaaccttcttttttggtatttaaaacgccaccttcaagagtttccttgtcagcaaaggcaatcgcatgaataataccatcaaccttaccaaatttatcttcaatttgtttaaaggccttttcaatattggcatcttctgaaacatcacattcaaccaatgcgattgaatcatccacaattttatttaaacttttttttatccggtcattttggtaagttaatacaacttttgcgccttgatccatgattgcttttgtacaaccccaagcaatactgtccttattcgctacacccataatgacaatggtttttccactaagaattccttccaactgcataacccctcttctagaatttactaaatcgttcatgtcgtcgctgcacgagttcatcagctgaaaattgacttaaacgatttacttctgtaactaacatttgttttaaattttgtgtactagtttgatcaacaacttctggaacaattttatcgataattccatcttcaagtaaatgttctggagttaattttaaagcctcagaagcttcaataacacgtttagaatccttccaaacgattgaagcataaccttcaggtgataaaactgaatagatactattttccatcatccaaactgtatcaccggtagccagagccaatgcacctccgctaccaccttcaccaacaataatactgatgtaagggacacgaagttccatccccactattaaactgttagcaattgctgaaccttgaccatgatactcagcatccattcctggataagcccctggtgtgttaacaaatgtaattactggtcgtttaaatttttcagcttgttgcattagacgtactgcttttcgatacccttcaggttcaacagttccaaaatgacgttcaatattttcagcggtatttttacctttttgggtaccaattacggttactggtgtaccgttcaatagagcaattccgccaatcacagcaggatcgtcacttaattgacggtctccatggaattccgtaaaattcgagaaaatattatttatcaaatcagcagttgcaactttatccttactgcgagcagcagtcactgtttcatatgctgtttttgccattttttatccctacttacttgtctgaatgtaaatttaaaagattattcaaatattcttttaaatttggtcgttcaacaatatcatctaagaatccatttttaagtaacgtttcggcttgttgaaaatccttaggtggcttctgattaatcgtttgttcaatcactcggcgaccggcaaaaccaattaatgtttttggttctgaaataataatatcagcttgcatggcataactagctgtaactccacctgtagtaggatcggttataactgcaatgtataataagccttccgcactatgacgagcaacttcatcagaaactctggccatttgcattaatgaatgaattccatcttgcattcgcgccccacctgaagcagtaaacataataactggtagatgttgccgagtcgcttcctggaacattcgtgcaattttacttcccgtcacttgacctaaactacccatgataaagcgtgaatccatcactccaatagcaaattcattgttaccaattttagcttttcctgtgaggacactttcattaacgtgagtcgttttaatccctgtagccagtttctttttgtacttttcatcgtctatattagtaggatcagtagccattgctttgtcccattcttcaaactcatcacaaagtaatttgattcgtttacgagaacctagccgtgcaccatacccacaattaggacacacttcataaacccctgcgcgacggtaataaaacttttcgtgacaattagaacattcgcgccacaaaccttctggaattttcttcaatcgcttaacaatttcatcttgagtaggaagtgagaatttattttgcattacttaaccactctttcaaaaagacattttcaatatatttagtcgtaaacaatccttgttcaaatcccttatcaactagtaaagcctctaagaatgccttatttgaagttacaccttcgatttcaaattcatctaaaacacgacgcatttttctagtcgcttgaacccgatttggcattttaacaattatttttgaaatcattgaatcgtaaaatggtgggatcatgctaccatatgtaattcccgaatcaatgcgtacacccattgttccatctggggaaaatagatgcttaatggtccccgccgatggcataaaaccattgcttgggtcttcggcattaattcgacattcaattgcatggcctaaaatttcaacgtctgcttggctgaaatcaagtttcaatccttcagcaatcttaatttgttctttgattaattcaattcccgttacctcttcagtaactgtatgctcaacttgaagtcgagtattcatttccatgaaataaaaattatgattttcatccatcaaaaactcaattgtaccagtattataataattgatggcctttgcagcccgaactacaatatcacctaaactttcgcgttcagaatgtgaaatagtggcgcatggcgtttcttcaattactttctggttatttcgttgcagcgaacaatcacgttcaggtaaaaatacataatgaccaaactgatctgcaataacttgcatttcaatatgtttagcattttcaatgattttttcaatatataaatcagaattaccaaaagaagtttcagcttcccgcttcgcttcttgataagctttcttaaggtcttctgacgaattaattcgacgaatcccttttccgccaccaccatcagcagctttaagcataattggataaccaatttgcttagccaccaccatggcattctctaaatcgcgaaccatgccgttgcttcccggaataaccggaacattcgcactaatcatcgtctcacgcgctcgagacttatttcccatcaagtcaatggttttatagtgcggtccaataaataccagattgctttctttacataaacgagcgaattccgcattttcggataaaaatccgtaacctggatgaatcgcgtcacagccagttaagacggcagcactgataatattaaacatgtttaaatatgaatcagcaggttgaggccctccaatgcagacggcttcatccgctaatttaacgaataaactattctcatcagctgtagaatagacactaactgcagcaatatccatttcgtgtaaggcacggataatttggaccgcgatttcaccacgattagcaactaaaaccttttgaaacatagatagcctccctgttcctagcccacaatgaaagttaaatcagcttcacagatcagttcgttattttcattaacaataaccccatgaccagtaccaatttgtcttttcattttggttaattcaaccgttaaagtaagtcgattgccaggaacaactctatttgaaaattcagcttgtttaattccgccaaagaaagcattttttccaacaaattcttcgtttgataaaagtgcacaagctcccgtttgtgctaaagcctcgactaagagtggctcaggcatgcagagctcgttgccattattaaaaaaccattcattgatggtaactttcttttcagcgaccgccttttttcctgcttcaagatcaactaattgatcaatcatttgaaaaggaggacgttgaggaataatatcttgaacattaatttccattaattatctccaactttacgaacacgagcaattggttgatcatattcaaccatcgatccattttcaactaagagttctacgacttcaccatcaactggtgaatgaacttcattaaacatcttcatggcttcgattaagcccacagtatcgccttttgaaatgtgactgccaaccttaatataaggatcttctctttctgaaggtgcaaaatagaccacccccacgaacggagccttaatctcttctaggttagcatccgctatttcagaagttgcttcaacgtcagtagcaacggcattaaccgttgctactggttgaactacttgagtagtttctttttttactttaatgctaaaatcaccttcagtcatttcgaatgacgtgaatgatgatttatctaatttggttaataacttttctaaatctatttcagtcaacattttcacctcttgaatgctaatacagcgttatgtccaccaaaaccaaatgaattactcaaggcatagttaacagaagccttacggttatcttctgtaactaatggaatgttaacttcagggtctttagtttctaaacctacgttaactggcataataccattttgaagtgctgcaatagttgcaacagcttcaattgctccagccgcaccaagcaaatgaccagtcattgacttagtactacttaccttataatggtcgttttcagtaaagatgctttcgatagcttttgattctgcactatcgttagcatgcgtactggtaccatgagcattgatataatcaatatcattggctttaatgccaccttcgtccattgccatttgcattgcacgaatggcaccgcgaccttcaggatctggttgggtcatatggaaagcatcacttgtcataccgtaaccaacgatttcagctaaaatattagcaccacgtgctttagcatggtcgtagtcttcaaggattaaagtagctgctccttcacccattacaaaaccattgcgatccttatcaaatggaattgaggcacgtaaacgatcttctgatgcagttaatgcagttaatgaagcgaaaccagcgattccaatttcattaattgatgattctgaaccacctgtaatcataacatctgcgtaaccatttttgatatggtggaatgcatttccaattgcattatttgcgctagcacaagcagtaacgattgcttgactggtattttttgcattgaaatacattgaaatgttcccagctgccatgttagtaattgagttagttacaaataatggtgaaacccgtcttggccctttatgatccattttaatgacttgttcttggatggtagttaatccaccaattcctgaaccataaattacaccgacttggtaaggatctaactcaccttctttaaaatcagcttgttccattgcttcaacggcagaatatagagcatattgagaaaatgcatccatccgtttcgcaatttttctttcaattctaacagttggatcaaagtccttaacctcaccggcaaccgtgatacctgttggttcggcatcaaaatgtgtaattttatcgattccaacttttgaactatttagtccttgaatgaaggattctcgatcatttccaagaggagtcaaagctcccatgcctgttactactactcgtctacccattttttcctcctcaaaaacctaaagggtcattccaccgtcaacggtaagtacttgaccagttatataatcattttcaagtaaaaaagctactgttgaagaaatttcttctggttgaccgaaacggtgcatcggaatcatttcttctgttttttcacgaaccttttcacttaattttccagtcatggctgtttcaatcatccctggagccacagcattacatctaatatttctcaaaagaccttcacgagctgtagtttttgttagaccaacaattccagctttacttgctgaatagttagcttgtccaacatttccatgagttcccgaaatacttgagatattgacaatgttgcctgaacgttgtttttgcataattttcatggcatattttgtcattgaaaatgtaccaactaagttagttgcaattacgtcattaaaatcttcaactgacattcgacttagtaacttatcttttgtaattccagcattatttacaataatatctaagtgaccaaattcttctttaatgtcgtttaacaattcgccaatctttgcatcatcacgaatgtcaagttctttaaagttgatatcaagtccttgaatttgttcttttactgcatcatccgaaatatcatggcgagcagtaacaaaaacctttgaacctttcttagctaaatccattgcgattgctaatccgattccttgagttccaccagtaacaactgccactgtatctttaataatcacttaattagcctcctgctttgaaagatagttccgtaatttttgtagtgtttcaacatcataaacattgaaaattggtaagtctttgttcttgagagtttttttagcaaatccactgagcgctttgccaggaccaatttctaccaaacaatcgattggatctgcctcaattacagctaaacaatccgtgaaataagttgggtttaccaactggtctggaagggtttgtttaatattagctttagtaaattcagtcttgatcgtattgctaattactggcacattcggttgagctactgtgacattttccaaacgggtcttcaagttatcactagccatttgcataaatggtgtgtgtgatgccacactcatcttaattggaacaacccgcttaactccagcagcttttaatagtgcactaaacttgttgattccagcggcatcgccaccgaaaaccgtttgcttaggtgtgttgtaatttgctggataaaccttaccaaactctcgggcagcatgcattgcctcgttcatcacatcatcactggcatttaaaactgctaccatttggcctggatttagtttccctgcttcagccatgtattttgaacgatcttcaagaacttttaaaccttcatcaattgaaaaaccatttgcggcaatcaaagcggaatattcacctaagctaagccccaagaacttctgcggtgcaatcttttcactgctaagaattcgtgcaattcctaaactcaaaataacaattgataattgtaaattttcttcattatcaataacatcttgtttagcaaaattttgacctaaaatttgactagcttcatcaactaatgctcgataggccggctctgtttgatacagatccattcccatcccttcaaattgttgtccttgtccgctaaataaataagccgctttaaccatcatttacccctttttaattacttatcgatgttttcgctaacgtaatcaactaacttgccaacagtatccatattttcgtctgtatcaatatcgatatcaaattcatcttctaacttgtcaacaacttcaaaaatgtctaagctatcagcgtccaagtcttctgaaaaacttgtttccatagtgatcttgtctgcgtctttttccaattgttctgcgattactgcttgtacctttgtgaatacttcttctttagtcataatattattcctccgagaatataatttaatttatttttttaatatttgataacatttgttccgacggttaagcccccgccaaagccgctgaagacgataatgtcaccgcgattaatttttccatctgctaacatttctgctaacaagacgggttcactggctgctgcggtgttaccgaagcgaccaatattgactggaaatttatccattgatagatctaactttttcgcaacgcttttaacaatacgttcatttgcttgatgaagtaagaaatactttacctcactaggatcaatgttcgcttcatgaagaactgtcaaaattgattcaggaactcgtttagtggcaaattcgtaaactttacgtccgttcatttggaagaaatacgattgtgctgggtcatctaaggctgctacgtttccagccgttagatactggcccatattcccatatgtattcaatttttcgttgattaaatatgaagagttcgaagaatcattttcagccaaaataccagccgctgcgtcaccgaacaaaacggctgtactacggtccgtccaatctagcaaccgggttagtttttccgcaccaattaagattgctttcttaaactttcctccatgaagcatattattaacaatgctcatgccgtacacaaaaccgctacatgcggcgctaatgtcaaaagccattgcattggttgcatcaatgctcccttgtactatagctgcaacagatggcgacatatagtccggtgacatcgttgccacgacaatcaaatcaatttcacttggatccgttttagatttctctaagagctgtttagcgacttctatcgccattgaagaagtagtttcttcaacggcttgatagcgttgcttgattcccgttctttttgaaatccattcatctgacgtatccagtattttagttaaatcatcgttagtaacgacttttttaggaatagatagtgctgaatcaattattctcaatcccattgcaattcaccgactatttatctttcttatcagttgctccaacaatgaatgttagttctgcttggcaaacttttttatcaccgaccattgcaaatgtttcaacaacacccatgtttctctttttcttgatcatttcaacatgaagttttaaaacatcaccaggacggacgatctgtctaaatttagcaccattaatggcacctagatatgctgtcttacctgcaaattcttctgattttagaatcaggattgatgcagcttgtgctagagattcaatgattaaaactccaggcataaccgggttaccaggaaaatgtccttggaaaaattcttcgttgattgtgacgtttttagtcgccacgattgattttccaggttctaattcatcaacatagtccatgaatagaatggggtaacgattaggaattagttccataatctctgttgtatttaaaatactcaaattattatttcctcctagtaattaatgatctgtactccaacgttattggaataataaaaagaataatcggtatttagtcttttcgcaatcaaaaaaaataataatagtaaaaaatttatttttatcactaaggctaaaaagacctacatatcaacactttacagctttttcacgatattaaaaacgttttcataaatcacagccatattagttaaccccgtgtactagaaatccctatttcatgcggtttgtgcagcctattaatcattttccccctctactaaagcaattgaatacaaaaacaacgtttgtgtaacgcgcgttatcagtagcttaaccaagattattagcggtatactatgattatctattattctaatttttaatcttaatctactaaggagaatagttttatgaaaatcatcgtccatattgatgaaatggcgaagtggccaatggttttaaataatctaaaccatttagaacaagcttaccctgctcccagtaatcagattgagctcttagtcaatggtgatgctgtgatgggcgttaaagccaatagcaaagaagcagaaaagattcatcatgctctcacgtctcagataatgcttgcagtttgtcaaaattcgttaacccagcggaaaattaccacggaggatttgcttaacaattccaccattgtggcttccggggtcgtagaattagttgagaagcaagccttggggtttcattacctaaggccctagtaattacctaaatgaacttttatcctaaggagaaatcataatgaaaaacgaaattttagttacaactactgaaaaaattcctggacaggaatatattgttttaggagaagtctttgggttaactacccaatctaaagacattttccgtaatattggcgctggtttaaaaaatattattggtggcgagattaaagactacactaaaatgttggatgaatcccgcaatattgcagtcgatcgccttcgagaaaatgcgatgaaaatgggcgcagatgcagtcgtgatgatgcgctttgattctggatcaattggtacagatatgcagtccgtggctgcctatggtacggcagttaagtttaaataaattaaaaaaaggaagtttctccgtaaattacgcagaaacttccttttttattccagtgatactttttgattttcaaacaagctatcatgatccgttagtttatcaggataatctatacctaaatatctaattaaacttgcccgcgaatgtctttagaagttaattctacctctaaagtttcacttaccatatttttagactcattttgtttaccacaatactcaactcaaagataacactaagaatgccaccaccagaggaacatttttcataacgtacttttctgcgaaaaacaaaataatcattaccctttttacgagttatttaaaatagttatattaatttttcttagtgtggcaaaaaaaaagatgaatcaaaaccctcttggatttcaactcatcttctttaattatttgctctttatttgaaagccttacgacggtcttccttaatacgagctgccttaccatgtaatgcacgtaggtagtaaagtttagcacgacgtacacgaccatgacggataacttcgattttagcaacacgtggtgaatgtagtgggaatgtacgttccacaccaacaccgttactgatcttacgaacagtgtatgtagcactaataccgctaccatggcgtttgataactacaccttcgaacaattggatacgttcgtggtcaccttcaacaaccttagcatgtactctaacagtatctcctgcacggaattcaggaatatcactacgtagttggtcctttgtaatcttatcaattaatagattcatttaaaaatcttcccttcgccaatcttcattaactcacccggagccagcggaacattgttattgttggtttttaaaccaattaatatcctaacatattctattattaagtgcaaaattattttggacttaatagtctataacgattttataaatcgggtgtttgaagttctcgtaagatttgtttatcttccggtgttaactgagctgtttctaacagatcggggcgccttgcaagtgtcttttttaaagactctgtccgtcgccattcatcgatttttccatgatttccgctcaacaaaattgatggaaccttcagccctcgaaaatcttcaggtcgcgtatattgtggaaattcaagtagacccgttgaaaatgaatcatcgactgcagaatctttatttcccaatatgtcaggtaataaacgtactgtagcatcaatcatggttaacgcagctaactcaccaccagtaattacaaagtctcccaaggatacttcatcatcgataagtgttttaatccgctcatcatagccttcgtaatgtccacaaataaatgtcagatgttcttctttagcaaaatcttcagccatcgtttggttaaattgcttgccaccaggatcaactaaaataactcgtccagtggattggttattttggctcttaacatgctccatcgcatcaaaaataggttgcggtgttagcagcatccctgctccgcctccatatggataatcgtcgacatttccatgtttattagtggaatattgtcgaaaatcagtaacgtcaacatttaacttaccggattcaattgctttaccaacaatggattcatgcaatggaacttctaccattttaggaaataaggttaaaacatcaattttcattaatctaacccctctggaacactaacttgaactgctccttgctccaaatcaacatttaaaattacatcttttaaatatggaagcaacaaatcgttttgattgggccgtttaactacccaaacatcattaggaccatacgatagaacttctttgatggttccaattttttggtcattctcaataacatctaatccgataatttgatgaagataaaattctccttcttcaagatcttggagttggttttcttcaactttcaaaatcatccctttaaacttttcaacatcgttaatggaattcattccttcaagagtaacgataaatgagcccttatattctttagcgtttttaaccgttacagtttgaacaggaacttcgtctttttcagtcttaaaaatttgtagttcagcaccagatttaaagcgctcttctgggaaatcggtatatgagataacttttagttcaccgcgtaaaccgcgggtattgacaatttttgctacattaaagtaattcatcttttatcctccgatacaaaaagaaggccgtaataaaactaatgttttatcgacgcccttcgttcaggtatgacctattttgtatacttagcttcgtgatacttcttcataattcctgctttagagaaaatatttttaactgtatcagaaggttgtgcaccattgtttaaccagtttaagatttcttcttcttcaagtttaactgaagctggttctgttaatggattgtatgttcctacttgggcaataaaacgaccatcacgtggtgaacgtgagtcagcgactacgacacggtagaaaggacgcttctttgaacccatacgtttcaaacggatctttacagacataatgacacctccaactatttaatcacgagtaataatataccagtaaatcgaatagatgtaaagtgtttttccttaacagatcgaaaaaactcccatttaattaaatttaacgttttttattagacttaaatgaccgctcgttatcttcttgtatcgctaaagcatcctcgccggcacataaagaccgttaccgttctgaatgctcatgtaaataacgccctataccaatcatttctgtttttgattcatttattttgggcattaatttttctagggtactatttccatacttttagtagaaatcctagtatcttttattagaaaacaaaaaagaggtttagttgtataaccaaacctcttaatttttagcgtcgtttatttttcttcatccgcttctttttgtttttcttatttttcttaatcatggaattcattgccatcttcgacaacttacccttgattccatttcctaacataccttccatgccgttaaagtttccttttgacatttggttcatcattttcttcatttgattaaattgtttaatcatccgattgacttcaaccacaggacgtccggatccagccgcaatccgacgacggcgactaggatttagaagatctggattttcacgctcagctttggtcatggaatatacaatcgccttggtgtgctcaagatccttagggtccacattcacattttgcatagctgggttattagccatacctggaatcattttcatgatatcctcaattggtcccatattttgaacttgattcaattgatccacgaaatcgttaaagtcgaatgtgttttcgcgaatcttttgagtcatttcagctgcttgcttttggtcgaaatctttttgggttttttcgatcaaagttaacatgtcacccatacctaaaatacgggaagccattcgatcaggatggaaaacatctaaatcttccatcttttcaccttgaccaacaaacttaattggcttaccagtgactgagcgaatcgacaatgcagcaccaccacgggtatcaccatctaacttagttaggattaccccagtaatatctaatttttcattaaatccttccgcagtgttaacggcgttttgaccggtcattgcatcaacaaccaagaggatttcatctggatgagccaacgctttaatatcagccaattcctgcattaatttttcgtcaatttgtagacgaccagctgtatcaataaaaacataatcgtttttattttcagcagcctgttccaaaccatggcgcacaatatcaacggggttaacatctgtaccttcttgataaaccggaacatctatttgttgcccaacttgaaccaactgatcaatcgctgccggacgataaacatcggccgcaatcaaaagtggacgagctttttgttcatttttaagttttaatgctaatttaccagtggtagttgttttaccagccccttgtaaaccagacatcataataattgttggaattttgggagacttatttaatggtgcatcttctgttcccatcatcttgattaattcatcattaaccaacttcacaatttgctgagcaggatttagtccatctaaaatatctgagccaattgcttggtctcggacggttttaacaaattgtttaactactttaaagttaacatcggcctctagcaacgctaagcgaatttcacgcatagtatcgcgtaaatcagcctcagtaactttacccttttttcttaaattagtgaaagttttttgtaatcgttcagttagaccctcaaaagccatttaaagcccctccgtctttattcttcttcacttttttcgagatcatctaaaaagtgttttaattcagtatcttccggatatttttgattaatataagcacgaatttgatcaaattttgcattacgcacttcaaaattacttaacaaatgaagttgctgctcgtacttctctaaaatatttaccgtccttttaatattatcatacacggcttgccgactgacctgaaattcttcggagatttcccccaatgaataatcgtccgcataatacagtgttatatactccttttgttttggagtcaataactgttcataaaattccaacaagctattaatgcgattatttttttcgatttccattggcgttaatcttccattagacccttaaagagtccacttacgtattgttctggattaaatggactaagatcgtccaccgtctctcctaaaccaacgtatttaactgctaaatgtaattgatttctaattgctaacacaattccacctttagccgttccatctaacttagttaaaataatccctgtaacattcgtagtttctaaaaatgccttagcctgtgttagggcattttgtcctgtagttgaatccaaaactaacaacgtttcttgcggagcatctggaatttcacgactaattacacgcttaattttatccaattcgttcatcaaattaaccttgttttgaagacgaccagctgtatcaactagtaataaatcgtaattttcttctttagcttttttaacagcttcgaaagctactgaagcaggatctgattgctctttaccagccaccacatcgactccatcgcgtttgccccattcttgcaactgttggattgctcctgcccggaatgtatcacaggctgcaagcaagactttacgtccacgtcctttaaagcgggcggccatttttccaatactagttgtcttcccaacgccattgacacctacaaagaggaatacggttggaccctccttactaaagaccaaatgattatcttctgcactaccatttctagtatacagagccactaagcgacgaactattaattgagaaatttggtcaggatctgaaacatgttcaaattcgatttcatcccgaacttcctcactgatttcaagtgctgtatcaaatccgacatcagcttcgattaatgtttcttccaaatcatcataaaaatcttcatctactccagaaaaattcgtaaataaggctgataatttttgtccaaatgattttcttgaacgttctaaaccgcggtcatagcgttctgcttcatccaacccattatctggagctgaactagtctgtgtttcagttttaagttcagacgtcgaagctccttctgttgaagaagtgggctcctcaattggatttgtttctactgcttggactggcttttcaacagcagcctgtgacgcaattgtactttgactctctgaatgagtctcacttaaagaatccttcttcactgttgtactaattgattcagattgaacctgtgaagttgggtcttgttcaaccttttgttcttttttcttttttctaccaaaaaaccatgccattattacacctgctttctttattccgcctcattcattgaaacagataccatttttgaaactcctgattcctgcattgtaacaccatacaaaacgtcggcttccatcatcgtacctttacgatgtgtaattacaataaattgggttgtaccttgaaaattcttaagatacttagcaaaacgttctacattcgcatcatcaaacgctgcttcaacttcatctaaaatacaaaacggaacaggtttaacttgtaaaattgcaaacaacaacgtaattgctgtcaacgatttctccccacctgaaagtaaactaagtcgttgtaatttcttccccggtggctgagccttaatttcaataccagttgtcaagaggttatccggatcagtcaactctaattcggctttacctcctccaaacattttaacaaaaactgagctaaattcttctgcaacttgatcaaaagtttgtttaaatctttgtccagcctcttgatcaatttcagcaatagactgttcaagttgagctttagaatctgccaggtcattcttttgatctctcaagaaattataacgggttgaaacccgatcatattcttcaattgccccgagattgaccgtacccaattcgtttaaacctttacgaagtagcttcaactctcgttctaaagattcatcctcaatatttcgaataatcacattttgaacactttcaaaagtttgttcatattcttgagttaacttatcaacggccatttcaattctactttgaactaatgtgagtgaaccttcgatttcctttaattgcgattcagcttgatgtaattgtcgctgagtaatctcataatcggcaataacgcgatcttgctgaacttgattttgttcaaaatcattttgcagttgcgccgataattggttctgttcagctaattgattcctaatatcatcaatatctaagtgtcttagatcactttctggaattagttcctcgtccaattgctgaattttaattttaatttcatcatttcgttctaacacatcgttaattgtagtctgtaatgtattcacttcgtgttgatgttgggaagtttgttccttaagtctagccaattcaattcgaagttctgaaatccgattttgacgttcatcaacatcgttatctaaaagggtaagttcatcttgtttagccgttgtagtttctttaatttgttgtacttgttgttgtatgttcgcaatttgagcaggcaaatcattttgttgattttcattatcgtcaatctgtgatagctcaaaacgtgttgccttaagtcgccgttgtaattccgttagtcgatcattttctaagctaacttgattacttaattctgagctcttttgttcagcttgatgttgttcttcaagtgcttgctttaactcagcttgaattgcttgtccttgttctagaattttttgaacttctgtttctttagaagctagcttggttttcatcgcagttacttgtacttgtaactttttaagttcttggtcttgctggagcacccccgttcggttgcctttagtagctccaccagtcatcgttcctccaattccaattacatcaccagccagcgtaataattcgattatggcggctaatctgcttagaaattattaaagcgttttgcaacgtatccacaattagagttgttcctaataaatattggctaataacttgattatcatctttcactttgactaaatcagctgcaacaccaacaaaacctggcatttctttcaccttttgtaaagtgtcttctctaatggaacgctgactaagagcattcttaggtaagaaggttactcggcctaaacgattttttttcaaatattcaataatcgatttagctgtttgatccgtgtctactaccacattttgaacttggttaccaagcgccgtttcgatagctaccgtatattcagctggaacgttcattacttctgaaacagggcctacgattcctctaaattgtgctttttgctgaagaactgctcgaacgccttgataaaatccagtatattcgtttttcaaatttaaaagagcttctaatttactttccgcccgatgggcaacgttggaaccatctaaccactgctgccgttccttttcatattgggcttgaagtcgatcccgttgtttagtcagtttagtaattcgctcttgttgaacattatttgcatcttttaaagtaagtaattgatgctccaaattttcacatttggtttttcgttgcttaatttgttcattcaacgtatccatcgtaagttggattttttgtctttgttgttgatcacgttcacgatcttgttgattaaaattatattggttttttaatgaagtcaatgcctgcaattgatcaacatattctgcccgcaaatcttcaatttcacgttttaaagcttctttttgttgttcaaggtggtcactttctaacactttcaaagattgcttagtgttagttaacttctgttgcacagctgctagttggccttgggcggcttctaaagcggcttgcttttcgacaagttgtttttttaatacttgttgctcgcttactaaacgttctttttcttgatctacatatttttgccgttccacccgtaaatcatgttcgccttctaattgttgctctagtcgatttaatttgaccaatttaatttgcaactgatctttttgatgattttgttcacttattacttttttaattttttctcgttggtcagctaaagcttccgattttatccgtaattgggcgagctgttctttttgttcttgacgctggacagctaattgcttttgagcttcagaattactgttaatggttcgaaccaatttcgtctgatctaaaatgtcaaagcgacgcttttgttgtacataatctttagcgacggctgcctgttcctctaaaggttgaacttgtttttccagctcgacaattaaatcattaacccgttctagataaccactagttttttctagttcattttcagcacgttttttatcctgtttatactctaaaactcccgccgcctcttcaataattgctcgacgatcttcgggcttactattgaagattgattcaacacgcccttgagaaataacggagaaagattcacgacctaaccctgtatcaataaataaattcaaaatatcttttaaccggcattcttggcgattcaattcatattgactttctccatttcgaaaaagtcgacggctaatcattacttcatcaaatttagaatctagaaagtgatccgaattgtcaaatataattgttacggatgctcttgaaaggggtttgcgtttttcggtacctgaaaaaatgacgtcaggcatcttgccaccacgtaaacttttagcagaggtttcccccatcacccatcgaatagcttcgataatattacttttccccgaaccgtttggaccaacaattccagtaataccatctttaaattcaatcttggtattatcagcaaatgatttaaacccactgatttcaatcgtgcgtagtttcatttaaaatacctatttaggcctacgtaaaagttgtagcgcctgattagccgcattttgttcagcaacctttttggaatgtccggttccagttgctagttttttatgatcagccgtaacactaaccgtaaagattaaatcattttcaggtccttcttcagaaactaattcataatcaatttcaacgtctccatttttttgaagtaattcttgaagttctgatttatggtcgataatgtgatcaaatttgccttcgtctaatttagggaaaatgacgattcgtacaaaacgctcgacagctgccctaccttgatcgaggtaaagagcaccaataaacgattcaaaaatatcacaaagaagtgatgagcgctggcgagcgccggatttttcttctcctttacctaaacgaatatattggtcaaaatgacattctttggcaaaatcactaaaactagcttcacaaaccattgcagctcgtaaacgggttagttttccttgtggcatttcaggataacgcttaaacaaatattcagagacaattagttgtaaaacagcgtctcctaaaaattcgattctttcgtaaaattttaattcttgatgtggatgttcattaacataagaagcttgcgtaaaagcttcatctaacaacgcatggttattaaaatgaatatcaaacgtctgacttaagtcatcttctaaggcttttatcatgaatatcttcctttccaaatctattaatttatttagcacataagaataactcggtgaccaattagattaatcaccgagttctcttagtatatgaaattaagcctgatgttcactaatataatcaactgcatccccaacagtaactaggttctcagcagcttcatcagtaatttcagctccaaaattatcttctaactctaacacgaactcaacaatatcaattgagtcagcatttaaatcttctttaaagtttagtgtattggtaatttgttcggtttttaattcaaaccgatctgctaaaatttcagcaattttattaaaaatttcttcttttgacaattttcagactcctctacttattgaatctctttagtattttaattgttttcgttttctttgtctacatcatcttgtttgatgctttcaagatgcatctcaaaataatccgctaaattcttaacgagctttgaatctacaatttcatgtacttgtaccaaagcatttttaacttggttagcattacttgaaccgtgagccttaactacgggagctttgacacctaataatacggctccaccttgtttagaataatccatctggtctttaatttggctaaaagcagatttaaggagtagaccacccatcttacctttaacaccgttgttcataattgtttctttgactagtttcaacatcgataaggctgtcccttcaatgtttttcaaaacagcatttcccgtaaaaccatcagtaacaactacatctgcagttccatttaataattcgcgagattcaatattaccaacaaaattgagtgaactatcattcttaagtagttggtaggcctctttatgaatcttatctcccttatcgtactcagttccattatttaaaagtgcaattcgtggattagtaacatgcatgacgttagtaccataaaagttacctaaaatggcaaaatcatgcaagtttttagctttactttcagcgttagctccaacatctagcatagtgaaattatcattttcacctttaagacttggcaaagtagtggtcattcctgggcgatcaagacctttaatacgtccgataataaacaaaccagcggctaaaagggcacctgtgttaccagccgaaaaaattgcatctgcatcgccattttttacagcttgggcagctaaaaccattgatgaatttttcttacgacgcacagctttaacgggttcatcttccattgtaattacttcatctgtatggaccactttaacatttctaaagtcgtccatgtatttagcaatttcatccttttttccatataagataaactcaacgtctggtagagcttttctggcttcgcttacccctttaacaatttcctctggagcattatctccacccatcgcatccactgcaatcttcataactcttctcctttaattaatctaaacttttatttatttgtattttattttctaagtaaagtcgtaaattttggtaacggggatcttggtcccacgctggctggcttacaattttagccgcatcaatttgggcagtttgcaaagcacctaaatcaacaaccggatcacccactttaaattcagggacccccgattgctgttttccaaacaaatcaccttgaccacgcattttcaaatccgcttctgaaatttcaaaaccatcattggtgtctaccataatttgcatacgttgctttccaacttcatttttgggatccgcaactaaaatacaataagcctgatattgaccacgaccgacgcgccctcgtagctgatgtaattgagctaacccaaatcgatccgcatcttgaattaccatcaaagtagcattaggaacatctaccccgacttcaatcacggtggtagaaactaatcccatatatttgccttctttgaaatctgccataatctgatctttttgggcaccatccattttaccatgcaaaattgcaatcggatatttttctccaaaaaattcacataattcttgataaagttccatcgcattttgtaaatccatggcttcagattcttcaattagtggggtcacaataaaggcttggcgaccattagcaaattccttagtcataaaggctaaaactttttcccattcccctcgcttaacccatttagtaataatgggcttcctacccgcgggagcttggtcaataattgacacgtccatatctccatacgtagtaatagctaaagttcgtgggattggagtagctgtcatggctaatatatcaggagctgcccccttctcacgtagtagttgtctctggtgtaccccaaaacgatgttgctcatctataataccaagccctaaatttttaaattggacatcttcttggatgatggcatgggtaccaactacaatatcaatttcaccatttttgatttctgctagcatttcatctctgatttttttacgaataccaccgactaataatgcaatcttaacatctaatttttcaaagaatcgacttaaattattagcatgctgttcagctaaaatttcagtgggagccatcaatgtggcttgcatcccggccgtcaaggttgcatacattgctatggcagccactacggttttaccactacccacatctccttgtaaaaggcggttcatgtgggcgggggacttaagattggccaaaatttcgttcgtcactcttttttgtgcatcggttaattcgaaaggtaacttttgaataaatgcacgcactaattgaatttgatatttaatcgccgttccattttcaattcgttcacgtgatttaaccaactgtaatcccatttgaaacgttaaaaactcttcaaacatcgcagttcgacgggcatcccgtgttttttgatcatccgctgggaaatgaagcgcttggaccattgctaatcgatgcagtaaccgatatttagtaatcaattcttctggaataacatcctgaatttgttcctcgtattggttaattgcatctgtaactaattgttgaatagtggcttgtcgaatatgcttgttagcaggataaacgggttgaagatttgcttcttcatcaataattttaattccagttaaactccgtcgattagcatcccatttcccatataccgcaatttcttcatcagcattaatttgatttttaatccacggctggttaaaaaaagttaccataacggactcattaccgattagaagacgaaaattaactcggactttttgacgcccaaaacgagctactgtaggctgggttgcaaccaccccttgaaatgtcactttttgttgatcaacgacattttgaggttccttagcggctaaatcttcatatcgaaatggataataagtaatcaagtcttctatggtcgaaataccaagttcggctaacgcttgtactcttttaggtccaactccaggaagcacttgaactgagtctgttaagcttttcattttccctccgtaaatcaaaaataggtcggctaataaccgacctataagtattattcaactgaaactaaaaatgggtaaactggctggtcaccttcatgaatttcaacttcaaggtcatcatcaatatctaaaattgcgttttgcaattgttctgccatctctgaagtagcatcttgaccgtaaataatcgtaacgatttcgctatcttcttctaacattaatttaaccatttcgaccgttgcatccatcaatttaggattggtattaacgattttaccatcaatcaatcccatataatcatcttgatgaatttcgcgtccgtccaatttagtatcacgaaccgcaattgttacttgtccacttttgacagtgtccaagttagattccatcgcttctgcattttcttccaaatcaacatctggattaaattcaagcattgctgccattccttgagagattgtccgactatggataatcttagttggaatatcagctacctcaacggcctgctcagcagctagaaaaatatttttgttattaggtaacacaatcgcttttttagcgcctgaatcattaatcatagctacgatatcagcggtacttggattcatcgtttgtccgccactaatgatatgcgttacccctaaactagtaaataatttagaaatacctgcacctgatgaaatcgcaattacagctgtttcaggagccgcttcttttgaggttgatgatgctgttggtgtttcatcttgttctatgatttcttcttgttgccaacgcatgttatcaactttaattttggtgatatcaccaaattgttggccccaagctaaaacttcgccagggtgttcggtatgaacatgcaccttaaccacttcatcatcattgataactagtaatgagtcacccatcttagctagataatcgtagaaagtatcgtaatcgaactccttagtaacttgcagtccttttccgattcgaaccatcatttgagtacaatatccaaattcaatatcttctggattaatttttccctgtacactttgatgatgtttagcatctaccatttcatttacttcagtagcatccggttcatgcttgtattcagtaatatcattaccattcaaaacgtcattaaacgcatcaaaaacaaatactaaaccttgaccaccggaatctactacgcctacttcttttaaaactggaagaagatcggtcgtctttttaagggctgtttgtgcagcactatcaatagcttccataacttcggctaaactatcagtcgttttaattgcctcattacctgccttagcagcttcacgaaccactgttagaatagttccttctgtaggcttcattaccgccttataagccgtttttgcgccttctgcgacagcttcggctaaatcttcagcattgagggttgctttaccttcaacgctcttagcaaatccgcggaaaatttgagataaaattaccccagagttaccacgtgctcccattaagagccctttagctaaagaagccgctaaatgccctacttccaaactagcatcgtcattttcatactttgcgccactttcaagtgaaaggctcatatttgttccagtatctccatctggtaccggaaaaacgttcaaagaattaataaaatccgcattcatttttaaacgatcagaactggcttgcaccatctgatcaaaaacttcattagtaatcaatgttcctattgcttccaaattcattatcctcctagttcaacgaacctaatcgttgagcaacttcacaccttgaacaaaaacattgaccgaattagcagaaatgccaagcattgattctaggctgtacttaacttttgattgtacattttttgatatttcagaaattttagtaccatatccaacgataatgtaaacatcgatggcgatcccatttgcttcttgtttaattactactccacgagcgtaattttctctttttagaatttcatttatgttgtcacgaatctggtttttactagccattccgacaaccccataattatcagttgcggctccgccaacaacagtagcaattacatcgtttgaaacgtcaattgttccattttttgtttttatcttgacagccatacccctgcctccttagtattcatatataccaacgatattttaccatatcccatacatgcattaaatacaagagcaaacatctgaattggatactgattattattataccgaggatattcatttattctaataaatttttttaagtgacaacctttttaaaaacgtaacggattatttgagtgtcaaggataattacttgaaagtttcctattgcaatatagcgggcaatatgataaattgttatggtgattgaaaaagatttctataaaaatatagaagtgacaaaggagggtttcgacatggcaaaagattttgtcacaggtaagcacactcgcttcggaaatactcgttcacacgctttgaaccacagtcgccgaagctggaagccaaatttacaaaaagttcgtatcttagttgacggcaagcccaaacgtgtttgggtatctgctcgagctttaaaatcaggtaaagttacacgcgtataaaaaaaagattggttagttgataaccaatcttttttattttgtcttaatctttactttgaattactgctaccaatccgttactcaagtaaacagtcgccttagaatcgataaattcattgctaacataagcacgagcatttgaaaccattgcattatgtaattcatatttttcatcatctaacgttaaaacatcgattttcgttaatgggataaaagataaatatttaaaaccttccaacttgtcgaccgtatgtttgccagaattaaaaaatctaatattattttgtcgatcaattaattcaatttgctctgcaaacattctaaaacggtcttggaggaccattaatacattggcaagtacatggtctaatcttcctccactaatccctaaaacgcgaatatgagcgcgaggatcatgatctaaagcatattttaatcctgattcagtatctgtatcatctttaactggatctagtttaattacttgctttgcattagcttcaatttctttaaactcttggccattaaccgaatcaaaatctcctactgctacttctggtattaaacccatttcaatcagttttaaagctccacgatctactccaatccaatctccttcaaaatcatttaaattatcaggtaaattttctggagctccaccaactaataagttaaaaattttcattattttgtaagttcctttaatagttgcacttgtttggtgtaatcttcagcgccgaaaacgtatgaaccagcaacggctacatctacgccagcatcatagaccgctttgatatttttgtctgaaattccaccatcaatttcaatatcaaattctaatccacgtgcttggcgtaatgcagatagtcgcttaaccttgctgattgagctttcaagaaacttttgtccaccaaaacctgggttaaccgacataatcaaaacttggtcaatttcgggtaatagttcttctaattctgttaatggagttccagggttaactactacttcagcgcgagctccagcatttttgataatttggattgctcgtgcaatatgctgagtactttcaacatgaacaccaacaatacttgcaccggctttaacaaattgttcaacatagttttctggattttgaatcatcaaatgtacgtctaatttgatatctgtatcttttgacaatccttgaactgtatttagtccaaaacttaagttaggtacgaagctaccatccatcacatcaacgtgaagatagtccgctccttctactttattaatatcacccattaagttagctgggtctgcacttaaaattgatggggctactttaatcatttcttcttcctccggtcctttttttgataacctttacgcttatattcaggtttttgattccgaatcagttcgataaactgttcataattagcataacggctgcttagcacactaccgtcttcaactgccactttgactgcacatcccggttcgtttagatgtaagcattctcgaaaacgacaattttggctgagcttcttaaaatcaataaaatattcttttaattgtgtatcagccatttcaaaaactgcataagttgaaaaacctggtgtatcagccactaaaccatcttcaatgggaatcaaagaaaccttacgcgtcgtgtgtttaccacgatttaatgcctgtgaaacttctccagtggcaatattcaactttgaatcaattcgatttaagagcgttgattttcccgcaccagtctgtcccataaaaatagttagttgatttttaaatgactctttcaattcgattaaatcagcatcaggttgactactaattggaaaaatcacttgatagccaattttttggtagtagccggcaattttttgtaaatcttgaaactccgttgggcttaaaagatccgtttttgaaaaatacaaaatagcctcaatatgtttttcagccaatgccactaattgacgatcgagcaaatttgccgaaaagctgggctgagttgctgcagtgacaattacagcttgatcgatattagctaatggcggacgcaccaactcattttcacgcgtatgaattttggtaatgtatccagtatcattttcactttccttaaaatcgaccatgtcacccactaacgggctagttttttgattgcgaaaattacctcgtgcccgagtcctaacgattttatggtcttctgttaacacatcataaaatcctgctaataattgtataatttgtccagtatgcatgcgtcctccgttaattagcaaccgtaaacgtaattgttgtcactcgtggcacaaccacttgaccagatacaacatcttgggagatgatgcgattattatcgaaacgattggtaactatttttctttttttaatggtaaatcctttagcttccaattgctttttggtgctactataatcacttccaacataattatcgacatcaaaactgttcggtcccttactgataacaatgttaactttgattccttcttgaacatattttccactttgtggaagcgtttcaactactttattataactcgttttatcatcagcttctttagttatttttccgactcctaaattcacttttgatagtttagtcatagcttgtttttgagttaaatcttctaaattgggaacctgtaccatttgcggactactcaacttgaaagcaatcaaaattcctaaaataaaagctaccgcggccattgccataaataaagctcttctccgtaatggatgacgacgtttaaagcgatgcatatgactttcttcagcatctggtgctttttctttcttagcaaaattgattttattgttcatttttaacttaattggtcgagttttttcaacctcatcttttgctaatccctgctttaattcgtcttgatttaaaacaatcgtatgttctaccaaagaatcttccacaaacttgctttcattagcccgttcaggctgtaaaaccgtcttcaaatcagcagccatctcggcaacatttttatatcgatcaattggattttttgctgttgctttcaaaaccacattttctaatgactggggaatttttgtattaaaatccttcaccaaaggtaactggtcttgataatgttttaccgcaattgatacggcactttcaccttcaaaaggaacttttccagtcaacatttcaaataaaataattcctaatgaataaatatccgattgttgcgtagcaatgtgtcctcgtacttgctctggcgataggtattgtaccgacccaatcaccgtattagttcgcgtaaaactactttgttgattagcaatcgcaattccaaaatcagtaattttagcttttccatgtttatcaattaagatattttgaggttttaaatcgcgatgaataatcccatgatagtgcgccgtctgaacaccatttaaaatttgactcattaagctaactacttgaccaagtggtataggaaactgatctctgatatattgcttaagattttgcccttcaacatattccataatcaaatagttcattccatgttcttcgccaatatcataaacaccgacaatattaggatgaaccagttctgtagtcgataaagcttcgcgttggaatcgtttgattgctgaaacatcatcttgcatgtcaaaacggaccagttttaccgcaacatctcgatctaaaattaaatcatgtgccagataaacattagccattccgccttctccaagtggtcgaataattttatatcgaccattcaaagtttggttaggggtcataatatatccccctcttctacttgaacaattaaagttgtaatattatctgttccacctgcagtgttagccatatctactaactgattagcttttttttcaaggctaagcgtactcatcaacacatttttgatcatatcatcagaaacaaatttagttaatccgtccgtgcaaagtagcaattcatcttctttggtaatatcaaatactttaatctcagcttcggcttgttctgaaattcctaaagttttagtaattacatttttttctggatggttacgagcttcttcaggagtaatttttcctaaacgaagtagttcattcactaaggagtgatcggtcgatagttgtttcaaaccatttttcgaactatataaatagcaacgactgtcgccaagattagctacaatcacttgcttacctaaaaagagtgccaaaacgatggttgttcccatgccatttaattttttatagtgcttagatgcttgcaaaattttacgattttcaagagcaagttggcgaattaaccaatttttagcatcagtaacattattaacgtcagaagtttcaaatagatacccaatgtgtgaaacggccatctcggaagctacatcgccgccccgattgccacccacaccgtcagctacaatggttaaaatagcttcagaatcatttttgaaaattcctacatagtcttggttagtctctcgaacttgtcctttatcagataggtacgcatatttcataacaccaatcacttcaccttttttaaattagcgatgaaaaagccgtctgattcaaaatcatcaggataaatattaaggctcaattcatctcgattttgcttgatttttttagctgtttcaactttgagttgttcaaattcaggatggatagctaggaatttctctatggtttcttgattttctttacgcaaaattgtacatgtactataagttagtacgccacctactttgagcattttagcaatattatccaagatttttaattggagttgatgaaggtcgctactatctttcttgctcttaagataacggatttctggttttcttctcatcaaaccaattcccgaacatggtgcatctactaaaattcgatcaaaactttcatctaaatcttcacgagatgcaatggcatcctgaacctcagttttaacgttgtctagatgcattctctgtgcattatcttgaattaattgcacccgtttttgatagatatcccatccagttacttctcctgtttcgccaatcatcgcggctatttgggtcgtcttccccccgggagcggcacaagcatctagtactttttgccccttctctaagtgcatcgtttctgcaactaacattgctgattcatcttgaacggtcaaatcaccatcaatataacttcttgtatcggaaatactagctcctctgctaaggcgtaaaccatctttagcaattgcacttgtcgttaccgtatactcatattctaaatctttaataatatccgcatgtgttttattccaacgattaatacgaaccgcaagatgggaaggttggttaatactcttcaaaattgaaatgcatttttcctcacccaattcatataacatttgatcaacaatccaaggcgcaacgctatattgagtcgataatctttccactggatttttgatcgaatcaaaacttggtttaccatttctctgatacgagcgtagcacacccgtcaccatttttctgataccgtcattgccccgaagcttagcaatttcaattgattcattaaaaatagcaaagtccggtacacggtctagaaactccatttggaaaacagctgttcttagtagattaatgacccagcgcggagtcatttctggttttctaatataatcagctaaataaaaatcaagagtgagtcgatgttgtaaaactccgtatacaatttctgttaacaaatttttatcaatatcaatcaatgatgaactttttatatcttgattaagttgaatattggaaaaagaaccttcatcaatcttttctaaaatatcaaccgctaaatttcgtgcactattattttgatttgtcattatctattatttgctttcctgggtgtaagttttcgcctaccccattgagatagtctgtaattgtcatcttttgtttgccagctggctgtaattcttcaatactaattacaccgtgttctccagttgctatcaagagctcatgcttcgtttttgaaacaacttgacccggttttaaatctgtagtttgatctattacttttgttttccatatcttagttcgtttgccttccatcataaagtaggctactgggaaaggtcgtaatccgcggacctttgcatctactagacgggccggtaaattaatatcaatttcttcttcttcggggctaatattaggcgaaaagctaacttgttcttcatcttgtttaactggttgaacatttccttcaattaattgaggtagcgtgtctaacaataagtcacgccctaaaagacttaacttttcaaacatggttcccacatcatcttggtcggtaataggaatttttgcagtagcaagcatttcaccagcatccatttttttaaccatatagataatagtaacaccagtttctttatcaccattcattatggcatagtgcacgggtgctcccccacgatattttggtaataatgaagcatgcacattgactgccccaatcttaacggagttaatcaaactcattggaagaaattgaccaaaagcagccgtgacaattaaatccgcatttaacgcgattagttctgtcaattcagtacttccacttaacttctctggttgataaaccttaatatcgtttctaacagcaactttttttactggactgggtgttaaaacatgttttcgcccgactttgcgatccggttgggtaactaccccaatcacatcatagtttggttcgtcaattaggctttgcaaaattggcgccgaaaattctggtgttcccataaaaataattgatttcataattagacctacttcctaaatattacaaaaagttttgtggttcggaatcaatactaatccgtgtcccctgtctaaatttctcctgcgatttgttcaatacttctaacagcgcacgatgtaatttaggctctttttgatatttaattaaaatttggtagtaatatttttgtttaatttttgagatagatttagccgtcggccctaacacaattgcattagctgataactgcggttgaataatattcaacatttcgtaagcattttttaacgcttgtctttcatcccgatctgaaacactaactaataccgtgtagtaataaggcggatatttgcctaaatgcctcaaatacatttctttatagaaaaagtcttcataatcttgtttttgagctaaacgaattgcatagtgatcggggttaaaggtttgaattagtacttcaccggtcttatcagcacgtccagcacgtccagcaacctgagttaaaagctggaaagttcgctcacttgcccgtaaatccggtaattctagtgctgtatccgcatttaaaactcctaccaaggttacatcaggaaaatccaaccccttagcaatcatttgcgtacccaaaagaatatctgcctcgtggttgccaaaacgttctaatagacgctcatgggctcccttgcgacgggtggtatcaacatccatccgaagtacgcgagcttcaggaatgatctctgccaattgctgttgaactttttcagttccagtaccgaaaaaccgaattttatcactaccacaatttttacataaacgtgggattgcttcttcatgaccacaataatgacaccgcatggttcgagaatccatatgcatcgttaaagatacatcacagttaggacaagttaggacaaaaccacacgttcgacacatcacgaaggatgaaaaacctcgccgattcaacattaaaactacttgttctttccttaaaatccgatgtcgaatttcttcaaccatgggtgccgaaaagttttcattatatccatcacctaaatgctgacgcatatcgatcacttgaatattcggtaaagccttttgattggctcgtttttgaatttttacaaaatcgtatcgcccacgttccacgcgagaacgactctcaagagaaggagtagcgcttcccaagactacgggacattcaaatttctttgcacgatgaatcgctacatctcgagcatgataacgcggtgcatcagattgcttatacgtttctgaatgttcctcatcaataattataataccaatattacgtagtggtgcaaagaccgccgaccgtgctccaactactactttaacttcatttcgtacaattcttcgccattcatcaaacttttcaccgtcagaaagtccactatggagaacagccacttgtgtaccaaaacgcgcccgaactcttttcaccattaagggtgttaaggaaatttctggaaccagtaaaagagcagttttccctttttttattacctgttggatactctgcaaataaacttctgtttttcccgatccagtaacgccttcaactaaaattggtttagcatttttgtcttcaattgcttgtgtaattaagttgtaagcggattgctgttcttcatttaaagccaaattttgatcaagctgcatctgacgtccttcaaaaggatcgcgatattgctcaaccgccttacgaactagccatccatttttaaccgctgtatttaatgttgagcgtcctacatcataatcatttaaaattgaagcttgcgaaattccctttttgacatctaacgttttaattatatttagtaactcaacttgtttcgtagcattttttcttaactttttttgttcttgttcatactcacttaaatccatcgtaggccaaagccaattaatcattttctttttagcagaatcttccgtgacatattctaatgtaacgaattcatctttaatccactgattaagttgtttttgttggctaaaactgagttcatttactttaagatctgtaacctgttcttcccctaataaggcaatcacggtttccattgtaatttttgtttcattgattttaataaaacgcttggtattaactttcaccaaacttggaagcattgcatttaaacaacttactcgaaaagcatacgtttggtcggctaaccactctgaaagctcaatcaattctttattcagcaatggttccggttctaaaactgaaatgatgtccttcaatccttcaaattcattagtagtttcttctccgaccacaaaaccttggataggccgctcagacttaccaaaaggaacaattactctggaaccaattttaatgtcatttttaatggcatcatttgcgatatatgtaaatggtgtattagtttgtaaagctgggacatttacgatgacattaaatttttttgccatgagttacgttcctttcaattaatttcttggtcgattagctttaaaatctgttcagcaattatcgatttatcattctttttcaattctatattagcttggtgcggacgtagaatggtgacagcattctgattagattcaaaaccgatttggggattacctacatcattagccacaatcatatttaggtttttcttaagaattttacgttgagcattttcaattaaatcattcgtctccgcagcaaaccccacaacgtatcgaagtgagtctggacgttttagtgtcgctaaaatatcagaattttcaatcaatttaatttccagttcaccattaaaatcatcttttttcattttatgatctgctattttcgccacgcggtaatctgaaactgctgcggccattatcaatatatctgcatcttgtactgctgtatcaagggcggcctgtaagtctgctacactcttaatatttatccgttgaatacttgatttcgctggtaaaactaagtttgtaggtccagaaattaaagtaacctgcgctcctaaccgttctgctacttgagcaagcgcaaaccccatcttaccagatgattcattaccaatataacgtacgggatcaatcgcttcacgcgtccccccagcagtaaccacaatgtgtgttcctttaaagagattttcccgcttttcaaggggcgtgctgataaaggcatttacgatttcagcatccggaaaacgtccttttccagaataaccttcagccagctctccaacagctggttctaaaacgactactccatctacttttaattgttcgatattccgttgaaccgctggattattccacatattaacattcattgctggtagcaacagcttagttgctgttgaagcaatcactacagttgaagcaaaatcatccgcaattccattcgccatttttccaataaaattagccgtggctggggcgattacaattttatctgcccagtctgccagagctacatgagcaactgggttttccgtattaatttcaaaatcatcatagacaaggtcattggtaagtgttgcaaacgttaatggtgtgacgaattttttggccatttgcgtcatcactaccttgacttgattaccacttttgatttgaaaccgtaccgcttcaaccactttatattcggcaattccgccagtaataacaaataaaattttcatatcgaacaacctccttctgctattttaccagtccttgaataccaatcccactaattgattaatccaacaaaaaagatgctagaggacaacctccaccatctttcataatttctataaatctttttcgtttggatcaatgataacatcgccagcaacaacttcttccaaagctttgccaacatttttttgtgaagtgtatttatctagtaattctggttgaccctcatccaattggtgtgcacgcttgctagcaagcataatcaatgaatatctggaatcaacacgttctagtaaatcatctactgaaggatataaaatcatcttataattctcctaacatttcttgatattcaggataaactctggttactcgaagatgttcacccttgataatatttttaatttcttcaaccgcattttcaatcttgtcgttaacgactgcataatcataatcacgcatcgtcttgatttcgtcaactgctttttccattcgtttattaatcgtatccatgtcttcagtcccgcgattgataatacgttgttttaattccatcaaatctggtggagtcaagaataaaaataccccgtctggcattttttcacgaacttgacgagcaccgttcacttcgatttctaggaaaacatctcgtcctgaatctagagtttgattaacatactttaatggtgtgccatagtaattatctacatactgggcatactccagcatttggccttctttgatatttttctcaaattcttctttagagacaaagtagtaatcttcaccatcaacttcaccttttctaggctttctagttgtcattgaaattgaatactgaaaatcattaccgccttgatcaaagattgcctttctaaccgttcccttaccaacaccggaagggccagatagaacaatcaacattcctcttctagccatgaacaaactcctcaaaatatatatgtaacttctattttgcacttttttattatatttttcaaccacaattgacttgaaaattaaagtaccatgttaataaacttttaacttttttaaattgttcgcttttttatcacatcagcgctaatttttcgagttttatttttcttgaatttccccactacagaatcgttagcgctacaccaacatttatacccaattcataaaaacagttgcttttaagaacgcatgttcgtataatgtaaatacaaacaaatgttcgttggaggctaacatggaaaacaaaaaatttaataactctttcaatcgaattaatcactcactcaataacatccgtaaaatgtataataacttattcctggtccctgaagaccaaggtttaccaattatggatcgtacaatgcccattgatcaaattaatgataccctggcatattcaattcaaaatcacctagtagtccgcatgcaactggatttaaaaaaatcaatcgttgaaatcgatggctatatccagattaccagatctggacgactatgcctgactgatcctaaaactgggctaacacaactcttagaagatcaacaaattcgaagcatcgccttaatttaaaaactctcactattaaaccgaaaatatccctaagaatcaaggatatctttcaatttgctagtgagagttttttagtgggcttgttccgtttttaataattcacgagcatgttctaagcttaattccgtgatattaaccccggctaacattttggcgatttcattaacccgtccttcgtcattcagcactgttaaattcgtcattgtacgtccatcgaccactttcttggccacatgcaactgatgatctgctctagctgcaacttgtggtaagtgggaaatacacaatacttgtgaatgggccgaaatttcatgaatcttatctgcaattgcttgtgctacacggccgcttaccccggtatcaacttcatcaaaaataatactagtaaccccttcgttacgcgcaaaaatagttttcaacgctaacattattcgtgagagctctccgccagacgctatttttgctaaaggtttcaaatcttcaccaggattaggttgaattaaaaattctaccccatcaaatccggttcgatctggttcagctttaggagtaaattgcactttaaattgtgttttttccatgtaaagacctgacaattgttcacgtatagctgcttctaatgctaaggccattctttgacgcatttccgtgagttgagttcctaattttttaactttttgatacctcgcttcaacttcctgtgcaagatcatccaaattgtttcctgaaccagtcatttcattgagttcattctcaattttattcaaatagttaagaatttcttcaattgaattaccatattttttctttagctgacgaactacttctaacctttgttcaacttcgtctaattcatttgaattccattccatcgcatcaagcgcagaacggactcgattagttacatcttctaaagcataataggcactttgtacctcatcagaaacttgttggtactcatcatcataatcagaaatactttgtaattcttgcattacgctaccaatttgatcaatcgcagaggccccatcttcaccttccaaaagttgaaaacttgttgaaagagcgtcggaaatactttgaaagttgtttaattgatctcgtcttttttcaagttcctcatcttcaccagccattaaattggcagacttaatttcttccacttgaaattgcaacatgtcaacgcgttgattccattcatgttcgttcttacgacttttatttaattgttggtttaatttagaataatcagcgtaagcttcttcatatttagcacggactttaccaaccattttttcgtcaaaatgatctaacaatgctagatgtttttcactattcattagttcttgatgttcattttgtccgtgaatatcaattaaagtttctccgactgattttagactatttagattaacgatcgtgccattgattcgacaaacacttcgaccacccttatggagttcccgagtaatcactaaatcattggttgcgtcgattcctaacttaattaacgcatttttagtattatcaatctcagcgatatcaaaaacaccttgtagaaccgccttgtctgcgccggttcttacaaaatctgctgagcctcttccaccagctaaaagtcctacggcatcaataataattgacttacctgcaccagtttctcccgtcagaacagtcattccttggttgaaactaacatcaagcttctcgataattgcgaaatcctttatagataattccaataacatatctaattctcctagatgtaagcaattgattgtgtaatccgatcctttaatcggactgcatgttcatcatcagtacaaataactagcactccattgtcatcactaactgctgcaaaaacaaacccatagtggacctgttttagcgttgctgaaatactagctccgtttcctggctttaaatcaataaacacaaacttttcctgaactttaattgaaatcaaagccgaacttaataacgtaaaaagtcgttgttcaatttgggaagtatcccctttagggagagaatatcgtactccaccttttttagtgggtgatttaattaattttaattcacgaatatcccttgaaacggtcgcctgcgtcacttcaacgccctgctcctgcaagtgaagtacgatatcttcttgacgatcaatttcattttcgttgataatttgtttaattagttcatgtcggtcgttttttcgcattgtttcacctatgaatttaagttggaatatgcactatcaatcactttttgggtatcaacattctcttcaatcactccttgatccgtatcggatcgttcaagccaggctaaaaattcgatattgccttctccacccttaattggtgaaaaatcaagtccctttacgttgaaaccttccgcattggccattgctagtacatttttaaggacctcttcatgaactttacggtcacgaacgatgccatgctttccaacattttctctaccggcttcaaactggggtttaatcaagctgacaactgatccatgcgttttaataatatttttaagcgctggtaaaattagttttaatgagataaatgaaacatcaattgatgcaaactctggttgtccctcagtaaagtcttctaatttactgtatctaaaattagtattttccattaccaccactcgtgggtcctcacgtaatttccatactaattgattagttcctacatctaaagcataactaagcttcgcaccattttggagcataacgtcagtaaatccacctgtcgaagaacctatatctaatactgtaagccccttaacatcaaggccaaagactttcaatgctttttctaattttaagcctccacggctaacatagggcattggtttaccctttaaatgtaacttaactgaagggtcaatcttgacaccaggtttatccaaacgctcctcgttgtctcctaaaatttctccggccattacggctctttttgctttttcacgggtatcaaaaagtccctgttctaccagcaatacatctacgcgttcttttgccatcgttaattctccattattttaaatacgttaaaaaaccttctaaaatcatcaaatccatttctggctgtaattcacctaaggaggttaagtcttgttcacatttttgaagaacctgatttaattcttcttttgctccacttaacccgagtaagttaacgtacgtatttttatttaaatctacatcttttccagccgttttaccaaggatcgctgtactttctgttacatcaattatatcgtcatggatttgaaaggctaaaccaaagtttgccataaaatctttaaccaattcggcaacttgaagtttgcttggcttcattatcaacgccgcttccgctgggaataatagcattttgccggttttaagatgatgtaaatgtttgagttcagctaaggaataatgtcgctgatttccttgaatatccaataattggccagcaatcatccctgaagccccagcatcacttgccaaggataacaccaattcacttttaatccgatcctttaaattggttgagctaatccattgaaaggccaccgttaaaagtgcatcaccagccaagatagcctctgcctcaccaaacttcttatggctggttggtcgtccacgccgtaaatcatcgttatccattgcgggtaaatcatcatgaatcaacgagtatgtatgtacagcttcgagagctgctgcgactgttaggatatcgtaattaggggtctttccgaatgctttcaaaattgccaataaaactaacggacgaactcgcttgccaccagcgtcaattgaatacttcatcatcatttttaaatcggtattcaatgttgaatcactatcaaacaattcatcgatgtgctgatcaagtaattctacgttttgtttgacaaagtcatcaaaattactattcattttctccgtctgtccccaaatctaagttagtctcttcaccattgtcttgcataacttttgtaagagttttttcagcattttttagggtttcttgtaattccgaacttaactgaattcctttttgaaattctgtcaaagctttttccaatggaatatcaccttgttctaaattggaaacaacttgttgtaattcttgtaaattttcttcaaatgttttttcttcagccattatttatcctcgctgttaattgttttaattactgcatttgcactaccatcactaaaattcagttgaattttatcgtcaattgataaatcctcaatcgatttaacgaccttcgtatctctagttacataagtataacctctactcattatcttgagggggctcagagtatctaaagatccaatcagcgaattcaaatcattcgcatactttgaaaaacgattagttatattattattggtcatctgtcgtagatgctcaacattttgttttgccattttaattctactagctggagtattggctaacaatcttgaatttagagttttaaatgatccctcagctgtagtaatttgttgtttctccaacgaaatcaacttttccgttaaaatatcaacattttgcacataaccttcatataaacgttgaggttcttgaaaaatatacgattgttgtaaatgttgaacctgctggctacgcatttttaaaatatttctaaacgccacaatagtttgtagctggagtttttgaagctcttctaagatatcggtcagtacaggcgtagctagttcagcggcggccgttggagttgctgcccgcatatctgcaactaaatcggcgattgtcgtatctgtttcatgtccgacagaggaaataaccggtaacttacttgcaaagattgctcgagcaactacttcttcattgaatggccataaatcttcaattgagcccccacctcggccaataatgatggtatcaaaatcatccaacgtattaatcatctttatttgtgcagctatactattggctgcctcattaccttgaactaaagctggaaataaaaccagttgaacaatcggataacgacggctcaccgtcgtgataatatctctaatcacggccccagaagggctagtcacaatcgcaatcttacggggatacttaggaattggtagcttaggggcttcaaataaaccttcttgggataattttatctttaactgttcatatgcttgatataaagctcctacaccatccggttgcatactatcgacataaatttggtaactaccatttcctgggtataaactaattcgcccactcacaatcactcgcatgccttcttcaggttgaaacttaaccttcgcaaatgcagatttaaacatgatcgcactaatcttcgcgttttcgtccttcaaactaaaatattggtgactgttagttcttaagcgaaagtttgaaatttcccccactaaataaacgcgatgtaaatacggatcagcatcaaattttcgtttaatataattggttagtgcactgaccgttaaatacttatcttcttgcatttaaatactccatttagttaaattcaccgtttgtttcattaacattgatattgtcatcggaccaacgcccttaggaacgggggtgatgtatgaaacatgtttttcgacattctcgaaatcaacgtctcccgttagtttaccattttcatcgcggtccataccaacgtcgataacaactgcaccttctttaacctgatcttctttaataaaatgggcaatacctgttgcgaccaccaagatatctgcttctttagtcagagcggctaaatttttagtataactatgagccaatgtaactgttgcgttggcattcaatagtaatgctgccattggttttccaacaatcgaactacgtcccaccactactgcacgcttaccttgaatatctatatgatatttttggaacatctccataattccttgcggtgtacatgcaatgggcgtgtgttgcgtctttccttcgaaaagtttccccacgttaactggatgaaagccatcaacatccttacgcggatcaatggccatcgttactttaaaagcatcgatatgcttagggagtggcatttggaccagaatggcattcacatcttcggtttgatttaattcttggatttttaggagcaattcattttcgctaatatcggcattcatcgtaactagcgttgatttaatgcctaacttattagcgcgcttttctttatttcttacgtaaatttgacttgctggattttcaccaactagaaccacaacaagatgtggttcgacaccttgatttttcaatttttgtacttcagtcattgtttgtttatcaatctcagcagctaaagtttttccatcaataatttggcccattattactcctccgtttcaaatatttatccatcttaaatcatatcataagatgcattttctttttaaatcttaaacaaattaaaaatggttgtaaatatcaagtgatattcacaaccattttttaattattttgcgatattagataaaactccattgataaatttacgagcatcttcatcagtatacttcttagctaactccaaagcttcattaatcgcaactttatctggtgtttcagtgtacttaatttcataagtacccatctgtaatataacgcggtcaggactttctaaacgttttactgtccatccctttttcaactctccactaatcgtttcattaatagcttcaagatttaagctaactcccataaccaaatcttttaagaattgatcgggagcttctgtctcatgaaattcttctaaaacttgatcttgcaattcgcttagatcagcgtctggattagcacttttagcaaagataatcttaaaggcgctctctcgaatttgatgtcgatttaaactcactatttatcaccattattttctgaaaaaatatcatcgggatcaatatcagatgtcgtcgtatctggcatcattccgttgacttgcacgttaacttcattaatcacaatttcggtcataaacaacatctgttgcttaactcgatcttgaatcttagtagcaacttgtggaacagatactccaaaatcaagcattacactaacattaatgactaagccacgatcatcttcaattaattttgtacctaatcccaaggaatcacgtcctaaaattgtattgaagcccttcgaaatattattaccaattaagtgaacaccatcgatttgatcaaccgtaattcctgcaattgattcaataacatcaggtgctatcgcaatcccgccactctttgaactagaattacttaactccaagtatttcgtatctgccattatattgcctccaaaaattaagcgcgtgaaatataagtaccatcttgagtattgatgttaagagcatctccctcattaacgaagaaaggaacttgaaccaccagaccagtttccattgtagctggttttgagccaccactagcagtattacctttaataccaggttctgtagcagtaacttttaaagtaatattcttaggcacttcaacaccaagtgtttcagtaccaaagaatgcgatacttacttccatgttctcaactaaataatttttctcttcttcaagacgttcattaggaatttcaacttgttcatacgtattgttatccatgaaaacgtagttagcaccatcattatatagatattgcatacgttttgtctcaatattagcttgttccattttttcgccggcacggaaagttttttcttgaacagcgccatttcttaagttcttcaacttagtacgcacaaaggcactacctttacccggcttaacatgttgaaattcaacaatgcgccaaatattatcatcaaattcaatggtcaaaccatttttaaaatcagatgttgaaattgtactcataaaaagattcctccaattaattctagaactaatgatatcaatcgattctctttttaacaagaaaatcattaaaaaaggccggaacaaagttattgtcccgacctgaaatttgcttttttaaagcttattcagcatctgctactggatatacagaaacttgacgcttgtcgcgacctttacgttcaaaacgaacgacaccatctgcaagtgcaaacaaagtatcatcgtttccacgaccaacatttacaccagggtaaatatgtgttccacgttgacggtagataatcatacctgccttagcagcttgtccgtcagcacgctttgttccaagacgacgaccagctgagtcacggccgttagaagtggaaccgccccccttatgatgagagaagaattgtagattcatttccatggttaattacacctccgaataaattaattcattactagatattctttgtatgacttactaatatcccttaatccaatctcaagtgcctcaagtaaaacttgagccattcgattcgaatcaacatcactgctttcaggaacattaacagataaaaatccaccattttcatcgtctgaatcaactagtggcattatcttagtgatttgctcgatactgttaactgtatttatcgataagactgacacagccgcacatacgatatcacgtccatactcaccagagtcagcatgaccagttatcttaaaaccactgattcgatctttatctctataaaaacaagtctgtatcatgccacatcaccttcaatcaaattaagcgttgattgaatcaatcataacttttgtatatggttgacgatgaccagtctttgtatgttggttcttcttagccttgtacttgaaagtagtaatcttcttttgcttaccttgtttttcaacagttccagcaactgaagcaccttcaacaacaggagaaccaacctttgtagattcgccacctacaaaaagaacttgatcaaaagtaactttttcgccttcagcgacgtttaacttttcaacgaatactgattgaccttcttcaactttaagttgtttaccaccagttttaataattgcgtacacaacgtgcacctccttaattctaagactcgccaaagtaagtgctatgctttaaaactcactttgtgcggttgtagcgtggagaccacaccaacgttaatactatactgtagatttaaataatagtcaatgttaatctacgaaaaaatcggaaaggtcaatattttgactatcaatttgaatttttgttcctaaaattttcttggctgcatttgccatataatgtgaagtgtataccattccttcatcaagccacattctaatcattccaattagaccatttacatagtatgagcttaaaacttcaatgggaaaaccatcatgctttacctttttgccgtaatattcagcaaaagttttaatttctgaattcaaacgttctttaagcacctcggtaaactgaggcaatttttccgtatctaatacaatcgtatacgtttgataatctgctgcaactttatcaaaaaagttggagactgatagtacattagttccatgagcatttttgtgattaacctcatcgacaaatccaactgaatcctttaatgatgaattaaataaagagcccactagttcgttaatcgtaaaattaacaaattcttttttgtcagaaaaatgtgaataaaaagctccacgggttaccccagcttcatcactaatttgcctaacattaatatctccagcgtcatatgtcttcaataacatcacaaaagccttttgcaatttacttaatgtcttaataattctaggatcttccttcatattcagcacctcacatttataaacgcttgattcacgttttagagtttaatctaatggaaacttttttacaataaactaactttttaaataacatgcggattatacccttaatgtccacgataccgtataaacctctacaaatgaacgattttcgcgcattttatttcttaaaatatattaaaatttatgcttttattgaaatatgtgcaaaaatacccatgtatccgcatttagtaatattctaataattaagaactgtatattaacataaatataagcaacaaaaaacaacgaagcatcatataaataatgttacttcgttgtccccattttttattcatttccgccaattttatataggtttttatctgctttagtatcttctaaaacttgtttatatattttttttcgatcattttcgtttttagtaattccatgcgtcattaatttaattgatttcaacatatttgatctaatcctaccactcaagtcatcatcaaaaccccgttgatgagtgtaagctttcttaacgatccctttaactccatttttatgatcgcctaaaagtgccttaaattttactcgatcactatcgttcattttcctttggccctttttaatcaaagcatctagagatctcatcactgatttttctgtttctgggttttcagaattaaacttttctagaccactgatagtcttctcaatcaacttcttatctgctgaaatttgcttgtatttttcaggagacaccactaccgtgccataaactttattatgggtgcatgcactcataaataatgttactaccatcagcgaaagtaaaaccgagataatttttttcatttaagccaccctctattcgttaacttctaatttaataatacctaataattcaaattaattaaagcgtttaaccccgtttaatttctttaatttataatgttgaaattgctttgttaattgcgatttatatccacttttttcatccctctatttgtaataattccattgacagaacgatcgtttttaaatatactgtttaagtacggttcggtagctcagctggatagagcatccgccttctaagcggacggtcgagagttcgaatctctcccgaatcatattaatatagcttagaagccctatggtataggcttttaaaacaagagcgctcaccaaacgctcactaagcaacataaaaatcactcaatctttaattagattgggtgatttttatttttaaatctttatactaagcaattaatgtgacttcgactaaaaaatcgaataaaatctaacatataattactagattaagtcaaaagtttaggagcattgctagaaatggatatcattattttaattggtgtttttattttcatgctaggattcttgattactgtatttaacaccaaaattcgatatgggttcatctttactcactatgaatatcgtaaccgttcaatgcattggttaagtgttattttaattatattaggccttatcatcataaccatcaaagcttatcttaatggccaatttaattagtttcgaaatataaaatatgtatatatgttcaaacaaaaaatcatcttatgggattatctttagagcgctagaatttctccattaaactaaaagaagctaaaccgatttttaacgatttagcttcttttatctatattaattattttccatccgagtcgaacacatcccagtaattatctggcggtgtatcttgcttggctagtttccaatgcgacggccctttatgggtagcctcaggatgctcttttaagcattcaaaacggcgatgtttttcatcttcgataataaaaacgcgatgaaattcgtcttgtttactaataactgttgcattttcgtgtttaaatccataaatatcagtatacgtcattcattatcacttccttagctaacttaaattttagaagtgaacagtaagcttctgtatcaattatttcacacctcgcagccatagtaaaacattatgatcttaacttaaactttgctttgcaatttactagcccataagaccattttctttaattgtctatacctttttcattcattgaaagaatcccattttagaaatagaggcattaactacaaatcttcaattattgaccgtattttacggttttattaattaatagaaaacccaaaaccagagcaggttttgggttttctgttatttcctattagtaattattttcttgacgctcgtaattaaccttatttttagcaaaaaagctttcctcaatttcttcaggagtaaatcctaagcctttaataccaaacttcataaacagatgccaagcatgtacataatctgtgcttcgattatacgcatacgccgaaaacaacattttcttaatatttaaatacattagagataagtcgggcgtacgagaatccgccttatacttatcaatttcttcatcttcaattactatcaaatgattccattggtttaaattagccatcaatagaaaaaaatcagtagcatccacaaactcattcaaaaccgtctgatggaccgataactctccgtcgcgtttgccacgatgagttttccataccttgaaccattctgcagcattagctatttctgcaagttcaacatccaaagatatataagcttcttgaatccggtcttgcatactattggccaagttatgtttaaatctaatatcacggtctaacgcaaccgatgtttgcaacatttttgcccaatccatcttaatcacctaaaataacatttttaattttaaatctgcaatatttctaacataccaatcgttcaagaaatcgtactgcttcaagatatcaaacaatgatttttcttcacttttatcattaacttgaatagcccattggtcggttgctggtatctcttgaaaaatcgagaaaactacatgattatctaattttaggtatgctcccaatagtttctcagcatttagcaaagtaaaaccatttttagcagcatccacaaaaagttcatcaataatatctgtatttaagctagtttgatcaaactcataaactttattattacgagcatcaaacatattaaagtcaacttcaaaattgtatacttcttctaaaatttggccaaatttagtaaataacttaatctcgtcaaccaagctatcttcgtcatcttgctgatttagaaaataaaaattattaattgtatcagtattaaagctcattttccgttcatctaaactcaaatgaaaaatagtttgttgcgttgcctgatcaacatattcagcctgattatttgccattttaaaacggaacttttggctagtccccgtccaagtatggaaaagtttttggtaattattttcttgttcaacttccagacccagtttagtttttaaaccgcttaattcaattaagcgagtcataaaaattaaataatagtcactagcttcaaatttctgaggaaaaataactgcatcgctatcaactacgaacgcataaagtttttttgcagcatccaataactcgacattatcatctgtagttgttaaagtacgaaataattctgcgaaactacgacctttgcttaatccagcatccaaatcagattgtactttcagcaacttgtcggataatgttgctctttttttatcttcattgattgtgttatccattagactttacctgcccttcgtctaataggctactgagataatttttatacagttggtcggcagtttcacggaactcactataactcgtgaaactcttctttaaagcctcaatttcaaaactgagcgtggtatcttccttggaaagaactaaaatttgcttttgattattacgaatttgttcaggagccttagccgcttgttcttcttcttcagcgatcttagcaagttcttccttaatttgttggcgttcttctttaatcttatttgattcaaataaaccgcccttatctgacaagttgttttgacgttccatcaattctttttgcttatcttcaagttcagtttgagcggtaaccactttttgtaactcaacatttttagctgataattggttgatttggtctgagtttaaagttttacccgcttcatcaatattcaatgctttttcaagcttttcaagtttttcttcgtctagtgtatattcaacattcaatgcatcaagtgtcccgatttcacggcgatcccaccaattaccaaagaagactttaaattgtcccttttcaacttcgcggtaatagaaaaatggaaatttttcgattaaataatcaatcaaattatcactcaagaaatgtgctaattcttgtctttgatcctttaccaactcaaatggatattctccaaattccaagtcgaaagcatcgttaatttcatcccgatagcgcaaaggtcctagcaattgataaatgcgcaaatcgttgtgctgatcaattgcttccgccaattcgtttatgtattgatccttgtttttcagttgcgagattaaaatatcccgactggattcttcgtgattcatacgttcatctgccatgatatcgctccattctatcgttctgtctctaatgttacaaaaaaatttcaaataaataaaggaattcgacaataaatttaaacattcttcacaaaaaaagagttacaacacgattaaccgtgttataactcttattatagatatttgtctagaacatttcgagatattgatcacgttcccattgtgtcacttcttgacggtaagaagcccattctaacttcttagcttcgaggaagctttggaaaatgtgatcccctaatgccttacgcattacatcatcattttggaattccttcaaagcattgtgtaatgttgaaggtagatctgtaatatgctcttcattacgttcttgaatgttcattcgatagatattacgatcaacggaatcttctggttcaatcttgtttctaatgccatctaagcctgcttccaatactgatgcaattgctaagtatgggttagcagctggatcgacgcttcgaacttcaaaacgagttgagagtcccttacttgaaggaacgcgaataagtggtgaacggtttgaacctgaccaagcaacgtatactggagcttcatatccaggaactaaacgtttgtacgagttaacaattgggttacatacggccgtataactacgagcatgcttcaatagtccaccaaggaaccagtaagcattttgagaaagttgtaagtcacccttttcgtcatagaaagcattgccttccttattgaaaagtgacatgtttaaatgcatccctgaaccattgattccatccataggtttaggcataaatgtagcatgcaggttatatttacgggcaactgtcttaacaaccaacttaaaggtttgaatgttatcggcagcggtcaaagcatcggcgtatttaaagtcaatttcgtgttgtcctggagcaacttcatgatgagaagcttcaacatcaaagcccatattttcaagttccaaaacaatatcacgacggcagttttcacctaaatcaacaggagctaaatcaaagtaactacctttatcatttaaattagtggttggtttaccattttcatctaatttcaacaagaaaaactcaggttcaggtccgatattaaaatcagtaaatcctgcatccttcatctcttggagtactcgaattaaattgttacgtggatcacccacgaatggtttacgatcatttgagtatacttcacaaataatgcgagccaccttgccatgttcgcttccccatgggaaaaccatccaagtagaaagatctgggtataaatacatgtcactttcttcaatccgaacaaacccgtcaattgaggaaccatcaaacatcaatttattatctaatagtttgtccaattgactaattggtacttcaacgttcttaattattccaaaaagatctgtaaacattaatcggagaaaacgtacattttcatcctttgccatctgacgaatatctgcttgcgaataatttttctttgccataactgtatgtaacgccccactttatttttttatactaaactcgtttaattggaaaggctgggccagaatcatccgatagccttccagtttgaagtaattcttctcttaagattttccgcatttgagtatccgaaatggagcgtttcagttcttcttttcgttgctcaaagcgttgcttgatatcagcaatattcaaaccttctgcaataaaatctttaatctcaagcaatcgatcaatatcgttcaacgaaaacaaacgtcgatttccttcacttcgatctggaaaaactaactcgttttcttcatagtatcgaatctgtcgagcagtaagagatgttaacttcataactgtaccaatcggtaaaacagccatcgagcgacgaagctctttttcactcataccaataactcctttaatattgaactaagtttaacagtcaatgatagctacgtcaatagctgatgttacattttctaacatcagttaaagaacgtttcttcaacggctttagtgattgcaatttttacgtgtgaataagttagaccaccttgtaaatacagtgtatatggtgggcgaattggtccgtcagcagaaaattcaacgctggctccttgaacaaaggtacccgctgccataataactttatcttcatatccagccatttgagatggctctggatcaacatatgaatcaattggtgaatttttttgtacttgcttagcaaagcgaatcattgaatctggttcaccaaagttaattgtttgaatcaaatccgtccgtggatcattccatttaggatcaacttgtaaattacacttttctaaaattgcgctctcaaaaatagcgcctttaattgctgctcccgtaacctcaggggccataaaaaatccctgatacattctgcgaagattttctagggtagctccctcttccttacctgcaccaacattagttaaacgattagcaatcatctcgattaatttttgctttccaacaacgtatccaccagtatgggcgattccacccccagcatttttaattaatgaacctaccatgacatcaacgcctacttcagttggttccactatttctgaaaattcaccatagcaattatcaacaaaaataatagcattgggtaaaatctcccgaacatgatctaccatcactttaatttcatcaacagtaaaactagaacgactagagtaacctcttgaacgttgaattgctactactttaacttgatccgtcaacttagtcttggcagctttaaaatcaacttttccattttctaacaaaggaacgtaatcgaaatcaattttaaagtctttcaatgaacccattcctgctttaccagtgacgccaatcacttcttgaatcgtatcataaggcatccccgttaagtataataacttatctccaggacgcaacattccaaaataggccgaactaattgtgtgagtcccagaaacaaattgtggccggaccaacgcatcttctgtcttaaaaacatcagcataaacccggtctagagcgtctcttcccatatcgttataaccgtatccagtcgctccatttaaattttcttcggaaattctttccttttgaaaggcttctaatactttccgttgattaaaagttacttgatcatcaatctcacttagtcgtggttgaatttgtttttcaacctcttcaatgattctttttacttccggtttaaaatcatctttccaattcatttttaacacctaaccagttttcaattttttgatatatctttgcttgctcttgtggattttggataatgtcataccaatttacatccatcttatttctaaaccatgtaagttgacgtttagcatagtgtctagaatccttttgtattagctcaatggtttctgataaagttttctcatttttaaagtaatcctgccactctcgatatccaatccccttgttggcttgtggtaccttagtttcgtcaaacaaccagcgtgcttcattttcaagtccagcgtctaacatcatgtttacccgatggttgatacgttggtataagatagagcgttccgtatttaagccaattagtaggtcatcataaaccgccgtcggttgcatttgctgttctgacatcttttggcctgacactttaaaaacttcaattgctcgaataattcgtcgccggttctttcgatcaatattttcgtaagttgctaaatcgattgtttttagtatcgataatagttcatcattttctttttgatttaactctgtacggatcgcttcaatttgatttcgatcttcattgctacctcctaactccaaatctcttaatagagcctgtaggtaaaaaccggttccaccaaccacaattggtagcttacctcgctgactaatttcactaatcaatttttgagccgtttctttaaaatcagcagctgaaaagcgatcatggatagtcttggtatcaatcaaatggtgtgggattccttgcatttcctctatggtaacttttgccgtgccaatatctaatttttgatagacttgcatcgaatccccagaaatgatctctccgttaaatttttttgcaatatcaatcgacaggttggtttttccgactgcagttggaccaacaatcgctaaaactttttccatattattctccctgcatcttttttctaatttttaaagctcttgttggatagtccgtgataatccccttaaaattctttttaaagcagtacttgatatcatcttcagaattgactgtccatggccgtaattggacgtgaggtaagaaaaatcgatgactacgcacccatgcgatacttgggtgccactcttgaataattcttcttctactgaatcggcgagctgctttcgtattaattttaaataagctagcagcttcaacttctggttgtaattgatgtaacacgctaatcgatttcggattaaaactggaatataccaaatggaatgggaaatcttcacccttaagaacttcataaaccttttgttcaattcctggatatttaattttatctgttttcaattctaggttaaaaataccatgatattttctttgaattaataaatcaactacttcctggagcgttggaatgcgttcattaacatacttttcactgaaatatgctcccgcatctaatttcttaatttcagctaaggttttatcaaaaatgcggccttctccatctgtggtccgattaacagtctcatcatgaataatgactaacttcccatctttagacaagtgaacatcagtctcaattccatcagcgccttcgtcaatagctttattaaaagccactattgtgttttctggtcgcacgcctttacttccacggtgggcaataatttgagtaatcatatcgttctcctatatctatttctggcattttaaatcaattcagcgcataattaaggtaatcataagtaaggagctgaataagatgggtaaatttgtaaaaggttttctatttggaacaatctcaacacttggtgcaattgctggggcactcttcgcttttcataaagtcgtagttgaacctgttgaagaacaagtcgaacgtaccgaagaaaatcgtcgtcgtgcgcaccgtaaacagcactctgcacataatggctaatctacacaaataaaaaagaggttgggttaattctattttaacccaatctctttttaatatttagtctttttagtttttccagtccaacgttgatatccattttttaaaatgtagagttgggtgaaaccttttttggatagaagcattgctgcacgtccactaaaagtacgtccttgatcgtataaataaaccggtaaatcagaacgcaattcttgggttctgtttttcatttgcgaatacggaatatttctagcaccaagaatatgacctgcatcaaattccttcttttctctaacatcaatcacttgtgctttacgcattccagctcgaaattcatcatcatctaattgagtcgaaatcttaccacgtttccagtataagtaaagttgataaactagatatgcaatgataaggatgatcacgattgtatttatccaaaatccggttgtatattttgcagcagcaacagccatgtttctctcatctccaaaatttttgttttatttatgcaaatacacgagctaatgaagcggcaccgattacaccagcgtcatttcctaagcgagctaattttaattgggttgaagaacgaacagttgagaatgcatattgttcgtaataattacggacacgttctaataagaaatcaccagctgctgaaactccgccaccgataacaatgctttcagggtttaaagtattagccaagttacctaaagcaagtcctaagagactgcagacccgatcaacaacacgaagagctaaaacgtcacccttctttgcaaggtcgaaaactaatttagaagtaatatcttgtccgtcatcagtttcacgtttaagttctgaatcgccagaaaattcttctgccatgtcgcgggctacatgaacaacacctgtagcactggcatattgttcaagacatccacgcttaccacatgtacataggtaaccttcaggatcaaccgtaacatgtccgatttcaccagcagctccagctaaaccatgaagcaattgtccaccagcaatcaaaccgccaccgataccggtaccaagagtaacgaaagaaacatcttcgccgttttctccagcacccttccaacgttcacctagaccagcaacattagcatcgttatcaatggcaaacttgattcctgtaccatcttcaattgcatccttaacgtattgagtttctttccagttcaggttgaaagcaccaattactgtaccattttcgcggtttacagttcccggtgttcccatcccgattccaataaattgatccttagtcatcttatataaatcaagatgatgattgattgagtcaataatgtctggaacaatgtgtgaaccttcatctaaaacatttgtttccacactccatttttgttgaacatcgccattttcagttaaaatagcaaacttaattgttgttccaccaagatcgacaccgattaatttacgttccattacttcgaaaccctccattatttttgttggttatctctaacctcttcaatatgatgctcatgtcgtaaaaccaactgagctttaacataggtcggtttatcgacgactcctgctttgtacaaatttttcaattcaatactcatcaattcaatatcccatttacgttttccaacgtaaacaaatattccgaattgctttaaaagttgttgcacatcataaagtgttttcataataccatctcaactaatttaccagattattgttatgatgtaaacgctaatttacaaaacgctatcatcataagaacgattaaaattgcactaccaatacgtttccaagttggaaccttaccaaatttagggaatccgattacatacgctattaaaaatccagaaactaaaccacctaaatgcgcaataatattcatgttagtacccaacagtccacttatcaagcccaaaacgctaaataatagcatttgtttacccatatcgattaatgcggggtactctcgatactgttctgccatcatcagccatacaccgataatcccaaaaatagccccacttgcaccggcagaaatactattagggtttgagagagccaaacttgctaaattagcaaaaagacctgaaaaaatatatattaatacaaatttccaatgaccaatcattcgttccaaaagcctaccaataaagtataacgcaatcatattaaacaagatatgttcaaatccaatatgaataaacatcgatgtaaatattgtccacagtccctgaccgttttgtaccagcaccggtaccaaagcaccgtgggtaactaggactgaaatattcgtgcttccgccgattagcgtcaaccaaagaaaaactaaaatattaattcccacgattgtttgtgtaacgaatgggccttcgtatagacgctttaaaagttgtttttgatcactcattaagaaccttccttttcaaaccgaatcatctaacgttcaaattgaaccccttcttctgtaataattttttctaatggtacatcaaaaggttctacatcccactgaggatctgaataaatttgttctgaaaaagctaaaactattttcgaggctggcgtttttttcaagtaacgatcgtaatatcctcccccaaatcccaaccgataaccattcgaaacttcataagctagaccagggacaattattagatccaatgcttcgggacgaaccacgttcccccctactggttctaaaattccttggaactttggttgcatgggtgtatttaaattatattcgacgaactccatctgtcgttctggcaaggtccgtgggacatagacacatttaccattttcaattagccgttgaatgatgggtgctgtgtctagctcaaagccgtgactcatggttatcgctaattttcgagcattttttacttcatgttgatcgaaaaaactttctaaaattaacgcctctttagctcttttagacgttatatcaatttgatttaagcgtttaatttgagtttgcctaaagatatttttattcattttatcccccatagttacatttaaatatataaaaaaagctagaagcgacagcaaattgcagtcttccagccttaattacgattattttgtttccttgtgtaatgtaactttgcgttcacgagggcaatacttgtttagttccaaacgatccggattgttacgtttgttcttgtttgataagtattgacggttatggcattcagtacattctaaagtaatgtgtacacgcattggaatgacctccattaatatatatatttgaattcgaaaatccactagcattgtacatgttaccactattctgaaaatttttccagaaccaattgcgattaattggaattcaagttctgagcagcggtttcagaggtcgctttagttggattagtaagggttgatttggattggacatatttccagtatgccgcatagatattcttagcagccgtcatattatccgattcagcatttgtacttaatcctggcagagctagtgctacaactacttgaggatcattagatggagcataagaagctaatgacaacgttacggttgttttcccattggttgtcgtctgagctgtaccagttttagcagaaattccgggagaaataccagctagtggcccaccggtcttatatttattacttccatgaaccacgtcatataacccatctgtaactaattttctctgtgcagaagtcatatcaacttgatttaaaacagttggtgaaacggtcttttggactgctcccatttttccattttgtttactacttctaatttgttcaaccacatgtggagcaacacgataaccaccatttgcaatggtcgacatgtattgcgcaacttgaatggttgtataagcatcataattaccaaaagataaatcgagcgctttaccaatattagcagagccagtaggtcctttaaacccggaagattcaccaggaaggtcaatgcctgttttagtacctagaccgaattgctcaaaatatccacgcaatttgttaaagacattaggatccatccctgacaaggatgcccctgaggagtacttaaaccctccttctttcatggctaattgcatcatatatgagttagaagaaacttctaacgctctcgaagcgtcaactgacatatttgcactaccagtactattaaaccaagaactctttgatcctgttccagccaccttaattggttcatcaatcaaggtattattgctaggagtaataaccccgtccatcaaagctccagaaattgttgcccccttaaccacggaacccattacaattggttcattaattgttcctaagacattatctgtcatcttacctgttgaaggatttcggtcagcaccagcaagcgcaatcactgctcctgttttaggattcattaccactgcatagccaccagttgattgtccaccagcgttttttgaggcctctttcataattttttggacttcttcttggaacttggagttaatcgttaaaacaagattatcaccttttttaccagcatattgttgaactttcttaacaatctgtcctcccgaactaacttgaatggcagtctgcgatttggttccctttaaaactgattcatactgtttttcgagataactttgtcccacgctatcattacgagcataaccttcagctaataaagtgttaacttcatcactaggtagaccagttttggaactacttaccgttcctgctagggacttaatgtcattcccctctggatagctacgagtccaacttgttgaaattttgaccccaggcatctcagaaaggtgctcaccaatctcagatagctccttactagaaacatccgtttccttaatataaaccgtagaaagttggtaagctccattcataattttaaaaattcgagcagcattttcttcctttgaacttaacttaatatccgaatttttgatatagtcaatttctttttcctgaactgccttactactcaaattttcacgattagtaattttcttttcgtagtatttactatttttagaatctgccagcaagtaattcgcaatatctgttcgactcaactctgtatcattggcttcaagatattttccaagtgtattagcaatattgaacatgtcttgagccattacgttggcacccttggtatacgaaatagcctgatgcgcagtatttcctactaaaacctttccagtagaatcgtaaatcaccccccgctgaacattattggtttcaacggtgttatcagttcgatttacgactgcttgcaacttcgagccatacaaaatttgtaaataccctaattgtccaactaacagtagtaataacgcaaagacaacaaaaaagatcaaattcaatcgaaatggtaattcactttttggtcgcctaatttttttaggatttttcattatttatgttgctccttttagatcacttcgttcattctaccagaaaatatatcggtgtactaatagtattaacaaagtcttaagcatgttttgtgctatcctattattatcaatttaaaggttgggattttaatggattttattaagaaacatcagaatttaattttaagtggatgtatccctgcttgcattatgctagcatacttcgtttatcgcggatttgctccatttggaacatctagtctattaactgtcgatatgggacagcaatatgtcgcgttctatgaatatttccgcagtacacttatcagtcatcctggtcagtttttctattctttttccaatggtttaggtggagatatgtttggtacttgggcttattatcttttcagtccaaccaatttgctgcttttgttttttaaaaaagagagtatcacttccggaatcctagtaataactgtactaaaatacgctttagctggactaacatctgctatttacttgcagcatcttgctcaaaaaaataaaatcaccactccgcgagctagtgttgttggttttgctactgcctatagtttgatggctttttccatcgccaatcaacttaaccttttttggctagatgctcccatcttattacccttaattattcttggtttggatgctctaattgatcaaaatcaaattaaaatttttgtaacgacgatgagcttaatggtcattataaattattactttgcttatatgattggtattttcaccttaatttactttttatggcgagcttcgccgttatcatggaaaaagatttttcactatgttcaatcttggatttacgttctagttttttccgccattgcttggatgccgacattatgggctctcctccatggtaaagcacagtatacagaaaactcaattaaatggtcttttgcttacacaccacttaaaatgttaactaaattaatgccagggacattcagctttaagcaaatgtctgatggtctaccaaatatttacgtgggaatgtttgtgttaatggcttttgtcgcctactttttcaataaaaatattggtttaaaaagacgacttggagctctattaataactgcttttttcttactttctttctgtttcaccccattaaacttattctggcatgccatgcaatttccatggtggtatgcatatcgttttagtttcatttttagtttctgggttcttattttagcttttgaaggactattacatcccatccaagaagcacttttaaaacccatcatcgctggtttagcactcattagtcttgttgcttatatatcaactaaaaatttaccaaaaattagcgactttatgaccgagaatcaaattcaatttggagttattatctttattgcagcgcttgtcttttgggttggtttccaagctaaagactttaatccggggctcacgccaattttagtttgttttatggccctagatttatctgtcaatgctatctggtcgttgaatcgtataagttatgttagccaaaccgaatttgctcaatatagctcagcagctcgcaatgcaatcgaccagattaaagaccaaggtcatcatttttcgaggattggtacaaattactctaggactaaaaatgatccaattcaattaggtttcaatagtggatcaagttttaactctaacctagaaactaatatgcttgatatgatgagtgctctgggccaacctacaacttccggaaatgtgacctatatgaacggaaccttgatctctgatgcccttctgaacttcaagtattggtcatttgtaaataacgaaactgaccataatcctttttcaactaaaagtgttcggcacgatgttttaaaaaggtatcatcagattggtaacactaaatatgctgataactacttaaatcaatatgcccttccattaggtcttactactactcatccggtaagtaataccaaaaaaattggaaatcctttgcaatatcaatctaatttactcaaaaaaatcagtaatcattctcaaaatttatttacagacattactaaccaggcccaaatttacttttcaaatgttacttccacgcctaatattaaaaatggtctgttaactaaacagaaacttaataaggctgccacggtaacttttgaatatgagccaaaaaataataatccaatttatattaccgccggatcacaactttcacatgataatgcggatatcttcgttaacaaccaacgaattactgaagaccttgattatgaccaaccaattgttttatcgattgcagatcagatgaaaggcaaaaaagttcgtattcaaattgttttaaagaagcaaagtttacttttatctgattttagtgtcgctgagcttcattacggcacatttaagcaagattaccaagctgctaagataaatagtctaacgcaggtgaaagacgctgggaacgtagtcacaggcaatttaaacgttaattctgataaaccctacttattcacttccatcccttacagttcgggatggcacattaaaattgatggtaaaacgattcctacttctaaagtcggtaattacttcttaggaagcaacgtaaaattaacttctggcaaacatcaaatcaagtttacttatataccaccattctttatgctaggtatgtctattaccataattggttttctaatgctcgtcttgctccaacaaaaaaagcttttcactcataagaagtgaaaagctttttttaatatgattagtttttaagcatttttaacggttaggattttaactttcatatctccaccgggagtagcgattgaaacttcatcgccaacttttttacctaaaagagctttagcaattggtgaatcgtttgaaattttaccagtcatagggtcggcttctgcagccccaacgatcgtatattcttctggttcttcatcaggaagctctttaaattcaaccactcggcctaaagaaacttcatcaccagcaatatcatcattatcaatgatttgtgcgtagtggagcatatgttcaaccgtattgattcggctttctaccatgctttgctcatctttagctgattcatattctgaattttcagatagatcgccaaagcttctagcgattttaatacgttcgataacttgtggacgagtctttgtttttaaagtttctagttcttcttctaacttagcttttccatccaaagtcattggataagttttttcatctgccatttttacacctcaaaattatttattaaaactctcatcgcgcccatcttctgatagaatatcgcgaacttttgtaaccaataaatcaatcgccacactgttttttccaccttcaggaacaatcacatcagcatagcgcttggttggctcaataaattggtggtacatgggtttaacacccgttaaatattgattaatgattgaatctaatgttcgtgcacgttgttccatatcgcgacgaatacgacgaataattctaatatcatcatcagtatcaacgtaaaccttaatgtctaacatatcacgaattcgctcatctgctaggattaaaatcccctcaaggataatcacgtcggttgggtcttgttcaataacttctgaacttcgcgtcgaaattttataatcataaataggaacttcgattttttggttgtttttcaacatttttaaatgttcatataaaaggtcggcatcaaaggccagtggatggtcgtaattaaccgcccggcgttcttccatcgttttttcagcttgatctttgtaatacgaatcttgttgaatgatagaaatcgaatgaccatgtaattcttcaagaattttttgactaacagttgtttttccactaccggatcccccggttaccccaataattattgggctgttctttgtactcataagcttaattcctcactatttaccttctggattgtacttcgcaactgcttcgttaaatgaagtaatgtctttgtagaacaagacgtctccaactttatgttttgaaccagatacattttttgtaactgcaaagaagaatagatatccgtctttagtatcagcattaaccacggatagaatagaatcttcaccaggattatcaactggtcctggcataaatccagtattcacccgagtgttatatgggttagtacttactaaatcggattgagttaagtcttctgttgcggattttttaactgcataacgtgttgaaacatcagatcctaatgtttcaccttgcttgatacgatttaagaagacccctgcaatcttagagcgatcgctagatttactaccttccatttcaactagtgacgctacactcaaagtttcctgaacggttaaaccatctgatttaatcttagaataataaggttgtaaaacagcatcctctttagcaaccatttgcgtaatgacatcttttagtttggtatttttatcaattgcataactagctgggaataagtacccttctaatcgatagcgcacgttttgagccttcatcgccgatcccagtaatttaggatattgcttagctagactctttataaagtcctcatctttcattaatttcaagaaatcggacttcttaaagtacttcgaagatttcatcgaattagcaatctgatcaatattttcgccttccttgattaatacgcgtggaccgttcaaggcaattggctctgctgctccacccttttcaagttttttagcgatttgttttaaagtcatcgatggttttaaaacataataacctgcttggaagttattgattttcttagacttagtgtagtaattgaatactgcaccactcttaacgacatgtttatcctctaggatcgagcccactcctcgtgaagttgttccaaccggaatattaatttcaatttgtttattgctcttcgcgtctaaaggttgtagggaagtgctgtaatagcggtatcccataaacgtagtgattaaaacaacagcaactaagataccaatcacccatttaataatgttgtgaccgtttttttgtcgtttatagttactctgtacacgactatgtctttgattcgaatcattgttattatccaagatcatttctcctatcatttacaataatggtaattatacaataactatctttaacttcgcattaaagtaacatagatttaatacggttatctaacggttacatttaatttctcttccaggtttttaattaccttagaaaattcatcattgatagcatcttcttgcaaagtatcatttgtatcttgataagtaaattgatatgccaaggacttcatccctttttcaaggttcttaccttcataaacatcaaacaattcaacttttatcaagttcttttgcttagtttcattaataacgtttagaacttctgtattagaaacttccttattaactaaaatagcaatgtctcgtgtaattgcaggatatttagaaattacgtcataatgttgtaacttcttttcggcatgaataatttttgttaaattcaattcaaaaacataagtttccttaatcttaaactcttctgcagtggttggatgaatttgaccaataaaaccaattacatctccatcaagcaaaacatcagcagtgcgtcccggatgcatcccctgacgatcatggtctgcaacataacttacttctccagcaacggcaacattcttaaggtattgttctacaattcccttaacatcaaagaaagttactggcttttctttttcattccaagacttagcctgcattgaacctgtaattgctcctgcaatatgttcaatttcttctggttgtgcttgtccatttccatagaaaactcgcccttgttcataaagagcaacattttccactgaacgtgccttattgtaagcaatatcatcaagtaatccactaattagattcattcttaaggcttctcggtcctttgtcattggccaatcgaccttcactagttcgtgatcacccttcacaaattgttgactcttggcaatggttgtaagtccataactcatggcttgagtaagccctaagccttccataactgttcttgaggcccgcatcaatttctgttcagtagtaagttgtccaatagttggatcaccagttggtaatgtcactggtaagttgtcgtaaccaaagattcgagcaacttcctctagcaagtcagcttcaatatgaatgtcccaacgacgaacgggaacagttaccttgaaggtctgctttgtagcatctaattctgtactaaatccaagtcgatcaaaaatagctacgacttcttcactagtaagtgacgtacctaaaattttgttaatacgagctaaagcgattgtaattgattcaggattaagtttagtatcattgccaacaactaccccgctcatcactttcccttgactaaaatcagctactaagctggctgcttcgtttaatgcatcatcaagtgaactatagtcaataccacgttcaaaacgcattgcagcttcgctatgtagattatggtaacgagcagttttacggattttaattgggtcaaaaattgctgcttcaataacaatattttgagtttgatcactaacttctgtagccattccacccattacaccagccattgcaatcggggtcccatcagctgtgattacaaggtcttctggacgcaaatcacgtttttcatcatctagagtagtaaatttaacattttcacccgctggagcaactgaaattgtttgacctttaagttggtccaaatcataggcatgaagaggttgtccatatttcaacataatgtaattagtaacatccactacattattaataggacgaattcccgccttcatcaatgtcgtttgtagccagaatggactaggcgcaattttcacgttttcaatggccatcaacttgtaaactggggcaacatcttgctcatcgatttcaacttttatttgatcggctaaagtatcagctgatttttgttcgtcttggaccttcaaaacttcaaaattagccttttgatctagaatagcggcaatttcgtgtgcattaccgttcatactgaacatatcaccacgattaggtgttacggatgtatcaatcacatcgtcatccattcctaaagcttccattacagaatcacctggtttaacatggctgtcagctgggaatacgtaaattccatctgcatagtctttaggtaccacattgtctgggtaaccaatttcttgcagagcacaaatcatcccattagatggaactccacgcattttgctacgcttaattttgacgttgtctttgattcttgaaccgtggagagcaacaataacatcttggtctgcagcaatattaggtgcaccacaaacaatttgaattggttcttcttcaccaacatcgacttggcaaatgtgcaaatgatctgaatcaggatgttcagtcacttctagggtatgacccacaacaattttctttaatttataatctaatcttgtaactgaatcaacttcaacagctgtacgttcaatcttttcagccaagtctttaggttctaagtctagttctaaatatttagataaccacttgtatgaaagtttcattttttattaacctcgcttattgaattgggataggaatctaacatcatttaggtagaaattacgaatatcatcaacaccataacgtaacattgcaaaacgatcaggtcctaatccaaaggcaaaaccaccgtaaacgtccgtgtccacaccagccattttcaaaacattaggatgaaccattccagcccctaatacttctatccaaccggttgacttacatactgaacagccttttcccatacaattaaagcaagtaacgtctgcttcaacagaaggttctgtaaatggaaaataacttggacgcaagcgtacttcgaaacgatcaccaaaaagttccttagccaaagttactaaagtacctttcaaatcacccatcgtaatgttcttatcaatcactaatccttcaatttgatggaattggtgtgaatgagtagcatcatcagtatcgcgacggtaaactacccctggtgagatcatttttaatggtccctttgaaaagtcatgtttttccattgttcgagcttgaactggagaagtttgagagcgcatcaaaacttcgtccgtgatgtaaaatgtatcttgcatatcacgagccggatgatctttaggcagatttagcatctcaaagttatagcggtcgagttcaacttctggtccttcaacaacttggtaacccatcccaaggaataaatcttccaagttatcaataatttgctgaataacatgcggttggccttgcttcatcggtgtccctggcaaagtaacatctacagcctcttcagctaattttttattcaaggctgcctgtgctaattcttctttacgttcttccaatttagatgttaggttatcacgtactttattagcaaattcaccgaccttaggacgttcctctttacttaaatcacgcatccctcggaggacctcagtaatcggaccttttttacctaaaaaattgacccgtacttcatttaattttgataattcattagcaacgctaatttcttgaagacctttttcttcaagttcttttaacttctcttgtaaactcatgatctttccacctttctccaaataaaaaaacgcccctcctagaaagggacgttttttaacgcggtaccacccttgtttgcaactcaatgcacacttggtcagccagatacgggtggcctgcccatttttaaatcgaagcgaattcactgaaaccatcatcggaatctctcaacctaacgattccttctctgtctgataatttaaatcagctactactcttcgagcttttattctcttagctactttaaccaaaaaaacgcattaggtcaatacctaattaaaaccagcaatcagcaaatttatgagcggcgtcaagcaccggacgtagattttcaccttgttctgttaatcgatactcaattaaggaagaatcctcataagtacatcgttccactagcccagcttcctctaagcttttcaaacgctctacaagtacacggtcactacatttcgtgacactatgcgcaatgtctttaaaacgctgtggaccagcattcataagcacttctaaaataagtccattccatttttttcctagtatatcaaacatcttttcaaactttggacaaagttcaaaatcagtttgttcttttagttgtgtactctgcattataaaaacctcttttactagataaacttaataaccttctctttatatttcatgagtttcatcttaaattccttgcggacatgatcaaaatattcagtaatagcttgttcgtcatctacaaatgacacaatactgctttcaaaatatttaggtcgcgcgatagtggctccccacatatgttttaatataatatctttttctttatcattcaagaccgtgagcttttccgcattacgtaaagcaacccgaggatggataaaggcgtgagaacccaaagtaaacttagttgttctccaatcgtaatagaataaatcatggagtaacccagctcgtgctgtcgaaacagcatctagattgtgttttttggctaacaaatagctttcataggaaacgctaatacagtgatccaaacgagttccattgtgatgttgagtgtagttatctaacttttgaacctcttttttctctaataaatctccaacaattgccatatattcagaatcatttttccaatctagtgacttcattaaaaagctcctttttagcttaagttactaccatcttagcgtcatacttttttaaatcaagtaaatctaactgccaaatttaaaacgtaacaaaaccttaaccggctaaaccaaacattaatactccagcagcaaccgccacattcaaagattctgcggaacccttgattggaatatataaattcatatccgtcatttcaataagtctttcactcatgccgttgccttcattccccataatcaaagagaactggtctggaacatcaattttacgatagtcacgggcattttcatctaaaattgagccaaaaattacactaccttgatccttacaattacgaatccatttctcaagattcaatcgtttcaactgcaagtgatactgactaccctgcatagcccttagaatcttagggttatagaaatcagctgtcccatcgccaaatacaactcctgtaaacccagccgcatcagccgttcttaccattgtaccaatatttccaggatcttgtacattatccaaaactaaccattttccagacaaatcatctggaaattgccaatcttcctcgttaatgtaaccaattaaaaagatgccttgatcgtgaacagtatctgaaatatgattagcaacttctttggtcactaaaattaatttgtcattatcgacttgttcagcaagctcacctaaatcaaagtcttcttggacaattaaaaactcatattcagttgcctgttccaaagccgtctccactggatgacgtccttctaaaagaaatttcttaaatttttttctaccattattggtttttagtttcacccattctttcacttttgaattctttgttgaagaaatcttttccataattataccttatctccttaccatttgtaagtattctgtttctatcctatttaatcgtatcattatcacaatctaaatgatatacagacttgccgaacttttaatcttaacacctttcatactaacaaattaaggtaacgatgttaaaattattaatataaatctttttgaaaggaatgattataatgaaagctgttcacatgaacgcttctggacaggtacaagccgtgggattccgttatacaaccaaattactagctgatcgacttaaagtaactggatgggtcaaaaacaaccccgatggtaccgtagaaattgaggcgcaggctccagacgctgttttagaccagtttattgatggagtaaaagcctcaccttcgccatctggacgagtcaataaattaactgttaaatcaattcccttatttgaagggcaagactttattgttaaatactaaatttcattgaaaaaagacggaaaatcaagtatagttacccttgtatttctagcattcagaagggaattgtacgtatattatgaaaaagcttaaaagtatctcgacgattactttaatctcgggactcgcattagttcttagtggatgtgtccaacgtgataaacacggtaatccgtatggaccgatctatgattatctagccatccccactcagcactttatgaattacctttcacacttactttgtggaagttatgggctagcgattattcttgttacttttgttgttcgtttaattttgcttccattgatgttaaatcaatctcgcaaagccacaattcaacaagaaaaaatggcatttattcagccccagcttaaggtacttcaagcacgtaatcaagcagccaaaacgcccgaagaacgtgccgctattagtcaggaaatgatggccttgtataaggataacaacgttagtatgactggtggaattggttgccttccaattatcatccaattccctgtttttgccgcgttatacgcagctattcagtattcacctgaattacatcaaggattattcctaggtattaatttggctaagccaagtatcttattggcagcaatttccttccttgtttacttattacaaggttggttaggtactttaggcgttgcaccagaacaaagaaaaatgatgcgttccatgatgattgtcagtcctttgatgattctatttttcactttttcttcccctggtggattaggactttactttgctgttggtggagtttttgcatgtatccaaacactcgcaattaatctctatcgtccaaaaattaaagcacggatccaagaggaaatgaaaaagaatcctcctaagattgttgaaccaactggtccagtagatcttaaaaatgctacagaagcagctacagaatttactagtgaacctgaaactaaaccagtttctaaaccacaaaataacaaacctcgtcgtaatgcaggtaaacaaaatcatcatcgtgactaaaattaaataccaaaaaaatccttggaaaattttgagtaaaactcattttccaaggattttttatttttcactaatttctatctgttgatcttcaataatcggtaatttaattctaaatattgaacctgaaccaactgaactttctagcgaaatatttccatgatattcttcagttaatttcttagcaatggataaacctaaaccgttcccaccttgatctcgactgcgagctttgtcgattcgatagaaacgattaaatacctgtttcagattttcttcagcaatcccctcaccaaaatcttgtacagcaatttcaacggtctttttggtattagcagttgaaatatgaatttctttgcgatcttttgagtacttgatggcattatcaagcaggattacgagaatttgttctaaatgattccgatatataggaacaatgggttcaccagtaatatcgtcatccattacgaaattaaattctggatgaatcatcttaaaatcattgaatacttgatttactaattgaacgacgttcgttttttcatcggcataattaatctcaatttgatcagctcgtgttagatctagcatttcactaactaaacttttcattcgttgcgtttcttctaaggacgctttaattgattcatccaaaacttgtggatcatcctttccccaacggtcaagcatctttaggtgaccttccacaactgccactggcgttcgcaattcatgtgatacatcttcaacgaactgtctctgttgatcaatatagcgttgcattcgatcaatcatatcattaaattcatgagccaagtccgataactcgtcatttgtatcaatttcaggaactcttaaatcggtttgaggatcttcctctaaattacgcatcgactgattaattaaattcattggttttaataagtatgccgttaatccataaccgaaaatggagattaccataaaaattaaaagcgacgttaaggtaaatagccagatcaagcgctgatatctgttattatatttcaccagtaaatcaacaactcgtacatacccgattacttgattatctttattaataatcggtgcttgtcccacaataatatctttatgatgaaatttactccgtttaattgactttcgctcggagagagtagtcttcatactaattctttgattcgaaaaaactgattctttttctaagttataaactgaaactactaaatctcgcctggttaaactcgctaacaatgaatcattaaaaccaccttggttattattaaccgccgatttttggtttaaatcaggtctgaatatatccgtagttttataattaatctcattcgcattttgaagacgacttcttacttgggttactgttgattccacatctcgatgttcttcagcatataatgaatctgttacaattttaaaaacaaaaaaagagaaaagtgcaaaaattaataggactccaacaccagtaccgatagcccatttccattttagcgacattctcttttttttaattactttattttccatactaggtcctcattacatatccagtaccacgtacggtttgaatgtagctaggacgtcccttaacatcaattttatttcggaggtatctaatgtacacatcgacaacgttagtttctacaccatcgtctacaccccataccttattcaataaagtttctcgagactgaaccacgttaatattttccattaataacaatagcaactcatattcacgtttagttaaattgattacttcgttattacgacgtacaactcgattttccttttcaataacaatatcttgaaattcaaccgttgtttggtggaaagtggaatcttgtgtttctaaatccactcggcgaagaactgcgcgtaaacgagcaagtaactcctcaatagcaaaaggttttacaatataatcatctgctccgtgatcaagacctgaaacacgatcaatgattgaatcgcgagctgtcatcataataataggagttattttttctcttctaatacgccgacatacttcaattccattaatttctggcaacattaaatcaagtaagatagcatcaaaatcttctgataatgctgcttctaaacctgtgcgtccgttagattgaacttcaacttcatatccttcatgctgtaattcaagttgaacaaaacgtgcaagacttttttcatcttcgattatcaaaatacgactcatttttttaccccaaaattaaattattttaaccctactgtagtaaattctaacattatccggttgctttgcctagcgcttccaatattatgttgcaaacaaaagggagtcaaatagcttccctaggcttccattcctttctaatccaatataaataagattgttagattatttgatttgactttgaaacgtaataatttaattatagtatcttaacttatttcacatcaattttgttattttaaaagtttttcgattctaagcaactatttttccatctagtgcttgcgttttgggttgcactatattggtgaaaagcctagcctctacttaagtggctcacttaatttgacctagtctcaaagtgatatccttaataatccatataaaaaaagcggtagccgtaacggttatcgcttttctatttaaactaatttttattgttcttcataccatggaaaatggtaaataccttcgcgatcaacacgttcgtaggtgtgagcaccaaagtaatcacgttgtgcttgaagaagatttgctggtaaaacagctgaacgatatgaatcatagtatgctaccgctgctgatagtgcgggaactggaattccagctttaacagcaagtgcaactacgtcacgaacggcttcttgatacttagcagcaatttcttggaagtatgaatccatcaaaaggttatttagttcaggattcttatcgaaagcatctgtaatattttgaaggaattgagcacggatgatacatccagcacgccagatcttggcaatttcaccaaaattcaagttccagtcataattttcagaagctacacgcatttgttcaaatccttgagcgtaactcataatcttactgaagtatagtgcgcgacgaattttttcgatgacttcatccttgtcaacgtcaattttcttttctggacctgcaagcactttacttgctgcgacacgttcgtccttaagcacggaaatataacgagcatatacagattcagtgatgagcgattgtggaacccctaattcaagtgcattttgtgaactccacttacctgttcctttattgccacccttatccataataagatcaacgattggtttatctgaaccaagatcgtccgttcttgttagaatatcagcagtaatatcgattagataactgtcaagttcaccttgattccagtcagcaaaaatatcagcaatttctttaactgggagacccaataacttacgcattaggtcgtaactttcatcgattaattgttcatcaccatattcaattccgttatgaaccattttaacgtaatgaccagctccgttaggtccaatataggtcacacatggatcgccgtctttagccttagcagagatttgttcgaagattggtgcaactaagtcataagcttctttttgtccacctggcatcattgaaggaccttgtaacgcacctaattcaccacctgaaacacctgtaccaatgaagttaattccagattcatccaattctttattacgacgcatagtgtcttcaaagttagtgttaccaccgtcgattaagacatctcctttgtcaagtaaaggaagtaattcagcaataacagcatcagttggtttaccagccttaaccatcatcataattcgacgaggcttttctagtgaatttacgaattcttcaatagaatatgcaggaactaatttcttttcagaatgatcttgcattactttttcagtttttgaggcagtacggttgtagatcgcaactgtatatcccctgctttcgatgtttaaagcgagatttttacccattacggccattcccactacaccaatttgtggttgatccatcgtgattcctcctctatatctaacaattgttccaagacattgattttaaaatactcgaaactttgtgtagcaatatattatattttaacagataagtaaaaaaaatgtataaaaagctgagaacctctaaggagatttaattaatatataacactaagcaatttatattcaatcgttttaaacacaaaaaaagaagtaaaaggacctaggctccttttacttcttttaacaaattagttagctttcacgtcaataacttgttttccgttatagtaaccacaacttgggcaaacacgatgtgaaactcgtaattcaccacagtttggacatggtgccaaacctggagtagttaacttaatgtgtccacgacgattacgcttacgtgtctttgatgttcttcttgctggaacagccatctatgagcacctcctttaagagaattcggtttcccgcttttttaaagccttacgattcaggattatctttcaataaaccctttaacttagcaaggcgtggatcaacttgtttttcatgctccgattccacgtccatctcagaaatcacttgccattctgcaccagaaggcatgactccctctttttcctcttcaggcgttaaaacctgcattggaacttgaaggacgatattatcttcaattagtttatcaacactaatcacatcatcttcaactagcattaccacttcttctttcgcaaaagaatcaataatactaggattatctacataaatttcacttatgaaaaagtctaaattcatgtggacaggcttcaatgatcgtgatgaaggaactgtcaaatcacaactgatctcagcatcaatgataactgaatcacgttcgattgtcaccgttcctttaaaattaattggtgagcatttaataactacatctggaaagcgttcgactaaagattgttccaaatccatcgtttcatcgaactgaaacggctctttgtgcttacgcagttctgtaaaataccattccataatgaacctccaatgcaacagaaacaattataccatgtggaaccacattgtcaacgtttattccttgacattcttttttataatagggccctttccccattgatatggagaaactaattggtataaatcgtctgctcgttttgtaattgcataattattttcaaaatcttctttggtgactttggtcattactactgatccaagggctgcttctcggataaaaatccggccgagctgatttgtcgccaataatctcgtcttagttagattaaacggagtagcttggatattaagtaaaatattcgttaaacttcgttgaattctagtataagtgtatcttttagtcttcaacttctgcatcaactctgtaaacgagttacttttatcaaccaaatttaaaatacgattttcgaaaccctctgtaacaccctttatatgacgtaattcttggggcgttgaagttaataaccgataatttaacattatccagaaatcttcccagcttgttaatttagcatttctaatagcctttaaagacgccttaggtaccgcgttaaagtactctgattgttctaaagctgccctccgaattgccgatgcactagcaatcgagccctttatctccgtatctcggtgatctgcttgttccctttgcaatggtattaactgcaagcctctttttgatttagaattccagtacgcataattgattcctagaatatcgttcgagttcataatggctgtatcatcaaataattgagctgcaaaattttgattatattttttggctctctggtcaaattgtcggtccagaatcttactctcattttcaaaatccaaatctggattttcactcccaaaagctaaaaagctagctcctaatttttgagcaatctctactcccgcatgggcaaattctttagcagaatcaatggcatattcagtaggtatttctacaactaaatcagcaccacaattaatggcaacccgtgctctctcccatttattaatcaaggcgggttccccccgctgtacaaaattgccactcataattacgatcactaagtccgccttagtaaccttgcgtgcctgctctaacaaatattgatgtccattatgaaatggattaaactctgcaatcactgcgcatgcttgcaatacagctacctcctacaactaaagaaccaccgagttgttttttcatctacttcagcttttccataatcagcatagtatttgattttagaaaaaccagctttttctaaaagtttaacgtacgtttccagttcatacgttcgttcaaaatgagtttcttcggtccgtctaaatagctcatcatcatttgctttggtaaaaaaagttaagtcatgttcgacatgatatttatctttgccttcgaagcttgaccaaatgaatgcttggcggtcatcttgatagttaaacatataacctgggtaaaccacccctgtttgatatggagtgatcacgtcaaagataaactggccgccagattttaagtgctcatacacttcgctaaacgactgtaacacttgttcttcatccggaaggtagcaaaaagaatcagcgtagcatgatacaacatcaaactgctctaattcacttaaatccaacatatttccttgaatcagttctgctgccacctcagcatctctagtgtgctgttctgctagagctaacatttcttctgacaaatcaaatcctgtgacgatttgtccatgctgtgcgagttgaacaaccaatcttcccgcaccacaagctaattcaagccaattatttttatgacttaaatcaacttctttttgcgtatattcaaaccaattttggtattcatcttcatcaaaaagttggtcatataactccgcaaagctttgatatatcattattctgcaatccaatcagttgtttcaactgcttcagcttgggaccaaagcttttccagattatagtactttctttgatccgtttggaaaacattaataacaatatttcctaagtcaatcaaaatccattctgcagcacgatttccttcaatacgacggatttcgatctggttttccttagccttttcaataatagcatctgcaatggcagctacttggcggttagaatcagcacttgtaatcataaagtagtctgctaaggtgctaacctcacgtacatttaaaacgattgtattttcagctcgtttgctatctgctgcttttactagtaattctaattcttctaaattgttcaatctatttctcctagttttaattaaattttgagatccatgcgttataactttcaatcgtagctggaaaaactggcttatttccagcgattaagtatgcaagggtactcttcatttggaaagtaacgcccttttgtaaactttgttctgtaattaaacgggcttgttctacgccttcaaaatcacgaccatcttcaatataatcggccatgaacactatttgatcaatcaatgtcatgtatggtgccccgacggtatgacgtcgaattgcatttaaaatttcttcatcataaatcttcaattcatttttaacgatttctgcgccaacaacaccatgccaaatagcattaccataatctaataattggggatcaagctctagttcattaatatatttaataaattcactatcactacgttgcttggcataatcgtgtagtaaaccggtaatactggctttctccacgtcagcatcatatttttgtgctaattcaatcgccttcttttcaactcgtagaacatgttcgaatcgacttccggtaatacttttagaaacagcgtcgattaattctgctcgcgtaaaaggcacgtagtttttttgataaattaattcttcattattgctcatataaacggtgctcctttatatacttttcgacactttcgggcacttgatacctaattgaacacccattcttaacgttttttctaattttggtggaactaatgtccatcttaggaacatctacccaaataatcggatattgttcttggcgttgatatttcggccgatcaacacccacaaattgaaccattttaactaattcgtcaattcgatgccaagtcggtaaatagtccgccatgtcaccgccaataataaaataatagtcattttccggatgtagttgttttaattctttaaccgtatcgtacgaataacttgagccaccacgattaatttcgattaaatctaaatcaaacagtgggttatcctgaatagctaagcggaccatttcaactcggtgctcagcaggaatggtttttttctcatcaacatgtggtggaataaaatctggaataaatagcaccttatccagtcccaactggcttcctacttgttcagcaattaataaatgagcaatgtgaggcggattaaacgtccctcccagaatgccaattttcttgcctttcttttgtattaatggctcttcaaccacttctacttgtactccagaaactgttttagattttgttgctatcaagattaatcacctttatctatatcttcttaactgtatctgaaatttcacgtttatccgcttccgaagaaactttaaacaacactagtacccgtccaatggtttgaactacttgaatatctgtattagattcaataaattctttagcttcagccgttgttgcatctgaattttgttggatattaatttttaataattcatggttgtctaaagctcctgccaattgattgagccatgcttcagttagaccatttttacccacggaaaaaactgggcggtatgaatgtgctcgagctctaagatatcttttttgttttcctcttaattccattgtttctccttttatttgcaacttaaattaatgatcgtcttattactactgaaataccctctggtgcccatgcagtaatcgtgcttccttcaggaacggatatccaacctaatccttcaaaaacaatatcactatcttgatctgcactaaactgatgtgcaactaatttaggcattttagccaaattatctgcagttggaggtgtcaataattcacctgcatgtttttcgtaaaaattatctgcgttttccaacttagtccgatgaaccataagattattatcaaaataagctgttacagagccctcagagtgttcgtaatcaaatcgagctaaagctcccacaaaaagagtttgttgactgtttagttggaatacacgaggtttaatcgtcttttgtggcgagacatatttcaaatcttccgcagccaatacatgtgccatttgatcggcatgaataattccgggtgtatcaatcaaattactatgatcatcgaacggaatttcaatgcgatctaaagtagtacccggaaaacgggaagtagtaattacatctttaattccattgcgaatagcaatcaaactattaattaaagttgacttcccaacatttgtaactccgactacataaacgtcccgacctttgcgtaatttttctaccgcattaaataaggcttccactgaactagcatttttagcactggtaataaccacatcttcaggcaaaataccatttgcctttgcttgttgtctaagccattctttcatacgatgacgtttgattgattttggaaagacatcttctttatttcctaccaacaatactggattgtctccaataaatcggtgaagtcctggaatcaaacttccattaaaatcaaacatgtcaactacatacacaactagtgagttggaatcactaatctgacttaataactttcggaagtcatcatcactaatgtctactggagcaatttcattgtagtgacgtaatctaaaacatctttgacaatataattggccagattctaatcccctttttaaggctgattctggtgtatatccaggcgcttttttatcagtcacttgtagaattgctccacaaccaatacaacgtaattcattttgttcgtccatttattgtaactccttatgccaaactaattccggatacttcttttttaaagaacgctttacaaagaattccaaaaaacggttgaatttagtattccaagcgtccgtttcaattaacggtttcactaaaactccccgcactccagctaaatttgcagcggccatatccgtaattaattggtctccaaccataatggtggagttcttatccaatttatttttgcgtaccactcgattaataccaacagtcaatggttttaaagctcttgaatcaaattcaagtccaaagccttcaactgctttcttaacgcgagcatggttattgttagaaactacgattactctaatattttcttgttttagatcttcgatccattgtcttaattcgggagttccatccggattattccaggcaattaacgtattatctaaatcggttaagacagtcgtaattcctttttggtttaaatcttttgcagataaattatatattttttcaatcatccacgttggtttaaaaatattcattaatcttctcccataaatgctatctgtctaattataaacgatagtagactcttttggaaagagagcaacctatacttgcaagcttaaatcttttatttcacttaactttatattatgtttagtacaagaggtgattatattatgaaagcaatcggtgttaatcaatttggtaatatttcagatttaattgaactagacgttccaaagccagagccttccagtggacgccttattgttcaaaccaaagcttttgcactaaacccatatgatttaggaattattgatggtactcaagccaagtttcgcccaatttcactgccagccattccaggtagtgatgttgcaggtatcatcgtggacaaagacccctccattaccgaattcaaccttggtgattcaattgtgggattggctaacctcaaaggttatagcgaatatgtttcagttccttatcgtcgagcaactaaacttcctgccgaaatcagttatcggacggctgcaggtcttcccaacgcaggtatcactgcgtatgatatcgtttttggagcattaaaagacgtttcgttttcaaaagtgctcattattggtgcctctggagcggtaggaactaacttgtatcaaattttaaatagtttaaataagcaagtttccgttgtaattaactccaagtatactgaacaattcgatactgcagattttaatcaagttgttttttacgatgctccaaaaacaattgagcaactaggtctttatgacgtaattattaacgttgcgccacaaaatgagctggccgacctttacttagcccaccttgctccatctggtttattgatttctacaactgggattgacaccttcaaaactgacccatcaagattagttgatttttacaacacagattacaaaatgaaccaagccgctttagaatatcttgttaaaaaagttgtaagtcaagaaataaccgtcccgattgccgaaatcttaaattttgatgtagctgaaattcaaaaagcttttcatgctcttcaaacgcatcatccgagagggaaatatatcgttgaagtttaattaacgttcagaaaataaataaaaaggattggttccaaaactcattgttttgttccaatcctttttatttattaattcatttaatctaatagattaaagagctttctttgcttcttcggctaaagccttgaatgcatcagcatcgttaactgcaagatcagcaagcatcttacggttcatatcgattccagcttcttttagaccatgcattaatttgctgtagcttaaaccattcattctagcagcagcattgatacgtgcaatccaaagacgacggaattcgcccttacgattacgacggtcacggaatgcatatagaccagacttcataacttggtctttagcaaccttaaattgaatatgttttgcaccgcgataacccttagcaagttttaaaacgcgtttacgacggcgacgtgtaactgttccaccttttactcgtggcataataaattcctccttaaatcacccgaaggtcatttgttctaaatttaaattcttaactagatgtttgaaagtaacttcttgtaacgctttacgttagtactgtccatcatgtctgtaccacgtaattgacgacgttgcttcttagtctttccatggaaacggtgacttgtataagcatttgcactcttaagaccgccattagcagttttcttaaaacgcttagcagcagcgcggtttgtcttcattttaggcataatctgttcctccagaattttaaattatttatcagcaattggtgatagcacaagaaacatacttctgccgtccatctttggatgaacctcaacacgtgcgacatctgaagtttctttagccattcgttcaagtaccttacgaccaatctctttatgagtgatggcacgtcccttaaaacgaattgaaacacgaactttatcacctttactcaagaacttagtagcgtttttaagcttagtattaaaatcatttgtatcaattgtaggactcaaacgaatttctttaatgctgacagtcttttgctttttacgagcttcacgttgtttcttttgttgctcgaatcgatattttccataatccataatcttggcaacgggtggcttagcctttggggatacgaccacgacgtctaagttagcttcctcagccatactaattgcttcagccttagttttaactcccaattgatcaccgttgacaccaattaagcggacttctctagcccgaatggtttcatttaccattatatcgtttgctatggttcttcacctccaggaaaattagcgagaatgcagaaaagcggatggcatacgccacccgctttgtttggataattaattagtatccattcaacgttctttagcccagcaacttaagttacaaggcgagaagcggtggcctctgctttttctcaacgtttattagaataccaaattctatgtctcatgtcaactaaagaaactatttgttttatcttttatttcaaaggaataaacgagcgtaaatcggtactaaaatatccatcgctaatgcaacgattactactgaaacagatgccatggctccttgaattgaacccaactgcactgccttagcagaaccaactgtatgcccagatgtacctaaacctaaacctaaccccacttttgaaatttctttaagcttgaaaaatttaataagaaattctgcaagagcgtaaataatcacagcatttatgatacaaaccatggctgttacggcagggtcacctccaatgctcttagctattggcattgccaccgccgttgtagcggcttgaggtaacattgctgcaatggagacttttgatagtccaaatagttttgaaaccatatgaataccgaaaagtgaaataaatccacccacaaataaagttaatactacatctatccaatattttttaaatatatcatttcgacgataaagtggaatagcaaaagcaatggtcgctggatttaaaaaccaaaatactatattaccacccggtaaaaagaattttttatagacttccacagttgtagagccaatccctttcgcccataatgccaaaataaagattcctaaaacaactcccaccagtaacggtgtaaataggaaaaagcctttactaatcttaaaaagccacatccccagtaaatataccaaaagcgatatgaagatacctgtaaaaggtgttgccaaggctgctgtcatattaatcatccccttttctattatttattttttgatgtaattttatgaaaaacgatcctacatacgtgattacaactaataaaataatggttgaaatgattgtcacaatgacatcctgtaagccttcacgcttaattaaatctaagcttcctgctaactgaattccagatggtacgaacaaaaaagcaatcaaaccaatcaatgaatcccccagtttttctacctgttcaagcttaataatgtgcgtcactaatagtatatataaaataatcattccaattaagggtgtcggaactgcaaaactaggcggaaataactgcgatagtaattgtgctacaaataaaattgccataaatattcccatttgaataaggattggtgtttctttcttcccatcttttttcattttagcttcctccctacctttatggatctaatactgtttatcacaaccttattttaagctattagctcatttatgttagcgctttcacataaagtgaccattttttgcttcaaaatgccatacagttcgtgttagttaccttggtttttaattaaaaaatcctcaacgattgagttgagaatttctaagaataggtatgaacttattctacaatttataaatattagatcatccaattcctaacacttttttagttttagcaacatatgatctactaaccgtaatcttggttccatttattaatgttaattcataagtatgattaaagctgggttgaaactccaaaatcatatctaaatttactagaaaacttctatgtactcgtagaaattgttctggatctaactgcttttcaaggttaatcaacgtttgtttgcttgagattaatggtaaatttttagtataaattaatacattcccattttgggcttctaaataaagaatatcgctctttttaataattatcgttctttcatcaactgtaactgaaagtcgcggatttttacacatgtcactattaactaatgcctctggcttttttaaaattctatcaactcgtttaagcgtttcatcaatacgatctttttcaaaaggttttaatatgtaatctgtagcattaacgtcaaatgcatctaaagcatattgatcgtaagccgtggcaaaaacaatatatggacgtagtttttcttcctttttcaagaattttgcaaatgacatcccatttccatcatcaagtctaatatctaaaaacattagatccggttgatccgtcattaatttttgtttagcttcagtgactccttctgcttcactaacgctatctactaacggattattcctcaataaaaaatcaagttcacttcgagctaggggctcatcatcaacaattaatatcttcactatctttacacctgttccttatatggaatttggattaccacctgggttccattttgatcactgcttatttttagttcggcatctttaccataaagacccatcaagcgcacattaagattttgtaatgccgttccactcccacttacagaacttaccgtctgttttcctaatttatcaataatacttttatcaatcccttgcccattgtcagtaatttcaattttaagtctttgtttaatctgttcaacattaattgaaactatattgcccttttttcgactattaaaggcatgcttaagggcattttcaacaataatttggatgctaaatggaggtatcattacattttccgaaaccttctggtgaaacaaaatttcaaatcgatttggaaaacgtgtttgttcaagcattaaataggctttaacatgtttgaattcttgatacaacggaatggttgtttctctaatccccgttaaatttgccctaaaataagtactgagttggatcagtaattcacgtgcttggtcactgtcgtaccgcataactgccacaattgtatttatcgcattaaagaaaaagtgcggattgactcgcgattggagagattttatttcggcatcccgcactaattctgattgatgctcgatttctcctaacattatctgcattgctaatatttctcccagccctgttcctaattgaatttccactggacttaatcgccattcttctacatagtagagtttcaaactacctactgctttacctttaatgattaaaggtactacgacggccgagtgtaatggacaactttttacagggcaattaatctcatgagcattatttccaatttgaacttcacccaatttaaccgcctcttcagataattccgtcaagatagaagcacctgtgatatggtgatcacttcccatccccgcaaaagccagaatcttagattcatctgtaataccaaccgcatcaaaatttgtatattccaatattaaactagcagcctttttagcggcttcttgatttaacccttgacgaaaaactggcaaagtttttaaagctaactgaaaaattgatttagtttgggtagcttgagtatcaacttcctgccgaaagtaaagcgtgataattgataagaaaaccgaagtccctaaagcacctactagcatcattggtattgcaatatattttaccaaagtccaacctgtcggactaaatagtaaaataaacagcatttggattgcttccattaaaagtcctactaaaaaaccatcaaacactttcattgttgcaaagcgatgttgttttttcttagcaaaaaaaccggctaaaattccaattatcatcgaactgggaatataaaaaagggcgtcggttgttagcgactcttgcaacattcggtgaagtccagcgactaagcctactccacccccaaccagcggcccgccaataattcctgaaactgtaaccgttaaaattcgaatattagctacagaatctccaggggtaacattctgcagaagggatttgaattgaatgctattatcaggtcgaagttcaacaccaattaaatttgctacaatcgtaaaaatagaaaaaatcgcaaataattggaaagttgttgaccaatcttttcgaaaaagtaatttcctaaattgaggaatatttactagaaaaaaagccaaaataataattaatccagctctttcaaacaaaagtacggttaaatttaacatgcctactccttacattaatcattctaaaactaccattcttaatcacaatataattataagcctttcaacggtcatcccttattaaagcctacaaaaaaataggattttaatgatattcacaccattaaaaatcctattttaattaaactattttagtcattttcgcgactgtaactttcaatttcacgaacgatattgttgataaagtcagcactagcttcattcttagaatcatcttcaccgtagtgacgtacactaacggagttattttctaattcattatcaccaacaactaagatatatggaatcttttgagtttgagcttcacgaatcttataacccatcttttcattacggtggtcaacttcaactcgaatgtctttatcgaccatttcttcacgaagtttatcggcataagcaccatgtaaatcatctttaacaggaatgattgtaacttgcttaggagctaaccaagttgggaaagcacccttatacatttcaatcaagtaagccgtgaaacgttccatagttgaaactaatccacggtgaatcattactggacgatgttcttccccgtcagccccaacataatgtaggtcaaattgctttggaagcataaagtctaattgaattgttgaaagtgtttcttcatttccaagggctgtcttagtttgaacgtcaagctttggaccgtagaatgcggcttcgccttcagcttcaacataatctaagccaagatcatccatagcagctttcaacatagattgtgacttgttccacatttcatcatcgtcaaaatacttttcagtattagcaggatcacgataacttaggcggaatgtgtagtcagtgatattgaaatcacgataaacttcaaccattaattgaagaacttttttaaattcagcttgaatttggtctggagccacaaatgtatgaccatcattcaacgtcatttcacgaactcgctgtaatccagaaagagcaccggatttttcgtaacgatgcatcatccctaattcagcaatccggattggtaattcacggtatgaacgaatatggtgcttataaacttggatatgtgaaggacagttcattggacggagttcaagcatttcgccatcacccatgtccattggtgggaacatgtcttcacgatagtgttgccagtgaccagaagtcttatatgcatcaaggttcatcaatactggagtgtaaacatgttggtaaccatgtttaacttccttatcaataatgtaacgttcaatggaacgacgaattgtagcaccatttggcatccagtaaggaagtcctgcaccaaccttagggtcaacgaagaacaagtctaaattgtttccaatgacacggtggtcacgttcgtgagcttccttttggcgttcaagttctgcttcaagatctttttgtttgtagaaagatgttccgtaaatccgttggagcatcggattacttgacttaccttcccaataagcacctgcaactgacaacaacttaacggctttcatatctgaagtgctaagtaaagcaacgttatcactaacaattatttttccatcaacgtcataaacactaactttgccatttttttcgttacgcttaacgattttagcttggtatgggtcaccatcaacgcttgctagggcttcttctacactaatttcactatgctttaagctaatcttagatttaataatgtccttcatcttatcttcgattgctggtaattggtcaactgaaatttgttgatcaaccttatctgtatcaacgtaaaaaccatgttctccgttgccaatctcaccaaaatgaactccaggatagatgctttcgatagcactagtcaaaactaaggctgccgaattccagttaacgatgttaccatcttctgaatcttttgtgacaatttcgatttttacgttttcgttaatagcttggtccaaacgaaccaaggcaccgttaattttcccagcaacagcttttttagcaaggctagtactgattgacttagcaatatctaaaattgaaacgccttgttcaaaaggttttacactgccatctggaaattcaatattaatttctgtcataacactctctccttaaatttatgtacaaaaaaagtccctggtataaaaataccagggacgtgattgtcatttattattcacgcggttccaccctaattgtagacagttaaaaaactatctaccactcgattaaaagccataacggtggcaaccgaactgggattgcgcccagcctctagtcaagtgggaagttttaagtgcatcgcttgcagtcgcggctccgctccctgaattaaaaactacatgtttgactgtgatttatacatttattctacctatttttgattgtttgtcaatcctgtcgatgattttttcccgtcatcgagacttcctcactcaaaaatttaattcgttccatcaatcttttcgcttttaaaggttctgcttcgcctctctgattgactgttagatgttctcgctctaattggtccattgaaaaattagatgtaaaaaatgttggtaattcttcttgcattcggtattcaagaattactcccaatacgtcatccctaatccaagaagaaatactatccgctccaatatcgtcaattaccaaaatcggagcttttttaatcgcatcgattttagtttgaatcgtattagaacttccaatcgcattttttaattcaacagctaaactaggaaaatgaacaatagttgtcgaatatccttcatcagccaaagcgttccccattgcgcccattagatacgtttttcccacaccaaaacttcccgtcaaatacaaacccttatgccaatcttgagggcgttctaaatattcgtttacaaacgctaaagttttagccaaagcgtctgttcgttctggttcctgatagtatccctccaatgaagcatgacggattaatttaggcatactaatcgatttaactaacgcttttcgatgacgttcttgttctaataaatgagtctgtttcgtgggcacatactcaatatcaatcaaatgattgcttaagactaattctggctgatatcccggtaaaaaggttgcttggttatttttaatcttatttcgttctgaaacaaattcatacagcttagccgctccacgttcgatagcttccttggatagttcgtcttgatgctcctcgcaaaaactaatcacttctggatcagaatacactgatttcatcacgttattaaaacgctggtcgagctttcttttgctcattaattcttgcaaaatttctcggacattttccatgactatccctccttgcctctagaacgaagttttttaagttgttcattaatttttttagttgtttctggattaacttgcttgggttctttagtcttagcggtctccgtagcccattcaggtaaggtttctctttgaatcgtacgccgatttttcgaataattattgttcgtatttttcttttgttcttggcgtttacgaataaattctaaagcttccactggagttttaattttatttttaatccagtcattggcaattgcttccactaaatttttatttaacgtaggtcgaccctgatcaacaataaaatagtaaactaaaaagtttatcacactaattggcattaaccctttaccaactaaatctgtgataattcttttttctgcagcagttgtaaagccccctgcttgtgctttcaaactttcaataaatgcgttgggtgacatagcataggttgcactaataatggcgcgttcttctgtagtaagtttagctagcgcattattcggaattgactcgtttttaggctgagaattcccatcatctttaaccggcgtctgcccattataagcgttcaaaactcgtgactttaattctttaggatcaattttgttatcttcataactcgtagaggctttgattaactgagccatttcgctttcattaatcccataaatagtctgttcaaccataattaaatgttcattttctagcaagctctgatgatctacaaaactagaacttagcatttgcgcaagtaatttaaaatcaaaatcttggttaataacttctgtatcaacttcatgctcggtttccgataaacttttctgaacctgattaattgcatctggtttatttattacgctacttcccaattgaaaatagtcgcccagctttttggaaacatcataaaattcgtcctgacgcacgtgctgcttaatcagtcgatgactcagccgatcgaattcactttcgccaatcacgcccagcaataaagcactcaaagtgtcatctttaaagaatttaacgggatcggctggagcttggagtgcatacaaaaataaacttcgacgatcaatttttctctgatacgtttttagtagacctagtgcttctaaacgtcctcgtgcctcaactatcgctggtagatcgattccaagccagtttaaaaggattgtatgtgtgtactgttctgagatcgatttggtttcctgactcatttcccacaaaaccatcatcaaactatatgcatctgaggtcaacaatggacgatatagtgtcgtcaatgaacgttgctcaaaatcagtaatttgacgttggctatcaattataaatgaatcatggggtgctaattcactcatctcagttgccatctactctttttccttttcttcgtcttttttcatcatatcttgcagctcatctaaaaagacatgcatatctttaaattgacggtaaacactagcaaaacgaatataagcaatctcatctaaatctactaaaatattcatcacatattcgccaataatttgacttgaaatttcgctctcacctaaagaacgaaccttattttcaaccttatcgaccatatccgtcatctgttccatgtttaagggccgtttttcagctgctcgtacaatcccttttaaaattttatctcgatcaaactcttctcttgatccatttttcttaataactagtaatggtgttgcttcaacacgttcaaacgtggtaaatctaaagccacatttttcacattctcttcttcgtcgaataacccgaccttcatcggttggtcgactatcaacaactcttgatccattatttccacagtgtggacatttcatttcgtttcacctcgccgaatgcttcggaagcttagaataaattcttgtcaacaagccattttaccacttgacttcgtgtctcttcaattgttccactggtatcaatcacaatatcagctttttttaccttttcttcgataggcatctgagcttgaattcttttttgagcgtcaatttcatttaaactatcacgttgcattaaacgttctacttgaatttgagcactagttttaatgaccattaaataatcaaccattttttcatatccttgctcaaagagcaccggagcatctaaaactactaccttacttgcgctaaaagtgtccaattgtcttactatttcggttcgaatataaggttgcacaattatatttagcttttccaattgtctttgatcattgaatacaattggtcctagttttcgacgatcaatattttgatttttatctagaatactttcaccaaaagtatccatcaatttcactttaacttcatcaactgttaagatttcgtgtgcaatttgatcagcatcaactaccggaattgctttagatttcaaaaattggctaatcgtcgttttacccattgcaatcccgccagttagaccaactatcactgtcatatcactacctcaaaacttggcaatgggggcaaaaatgggtcccacgttgtgccactttaatccgttcaatgggtgtcccgcatcgctgacacggcaaaccttggcgatggtatacatgcaactggttttgaaaacttcccgcatgaccatccgcattcaaataagaaaaaaccgtcgttcctttagcttcaatcgccaattgcaactcttcaaaaattgattcacgcaaaattgcaatttcttcatcagttaaagtattagaaatctgctgaggatgaattttgcttagccacaatacttcatcagcgtagatattgcctaaaccagcaatcatggactgatccaatagaaaacttttcattccacgttttcgattccgtagctgatgggttaaatattctaaggtaagggtctcaggcgttggttctggtccaatcgtttttaaaccgcccacttgtaattcctcacccgtgggtaccaaattcatcctaccgaattttctagtgtcgttgtaccgaagatcttttccatcatcaagctcgaaaataacgtgatcatgcttgccatactcttcacgacgatcaactacagagtatttaccctccatgcgaagatgagaaaccatcgtgtaatctccactaaaatcaattaatagatatttaccgcgtcgtcgaacattaagaatttttttaccctctagttcttctgcaaaaatttccgcttttggtgagaccatttttgaataacgtactacaacattagtaactatttttccttcaactaaggctgctaggcctctacgaactgtttcaacttctggtaattcaggcatacttctcccccgttatttagcgtcgtaccacgtatttccccaagctgctccaactttaagtggaacatccaatttaactgctgagtccataaccttcggtactaattctttcattaacgtcatttcttcatccggaacttcaaaaatcaattcatcatgcacttggagtaacattctactcctcaagttacgcttttctaattcattttgcatatcgatcatcgcaatcttaataatatcagcagcactaccttgaataggcgtattcatagcggttctttccgcaaatgaacgtaaattaaagctagacgaattaatgtctggtaagtaacgtcgacggtgcgcaattgtttctacgtagccttgttctttagctaactgaactgattcatcaatatatttttttacaccaggaaattccttaaagtatgtttcgataaatttcttggcatctttcctagaaattccaatgttttgggacaaaccatagtcactgataccatacacaattccaaaattaactgctttagcttgacgtcggatattaggagttacctcgctagcatcctttaatccaaatattttaactgcagttgtagcatgaatatcttcgccatttttaaatgcttcctgtaaattctgatcacctgtaatatgtgctaatacacgtaattcaatttgtgagtaatccgatgataaaatatgccacccttcacgagctggaacaaaggcttggcgaatcttcctaccctcttcaatgcgcaccggaatattttgtaaattagggtcaatggaagatagtcggcccgtttgggtcaaagtttgtacataggttgtatgcactttttcatcagtcgtatgaattacttttaaaagcccatcaacataagttgatttaatttttgaaagcgtacggtagttcaaaatattatcaataattggtgactcgccttgtaatttctctaagacgtctaccgcagttgaataccctgttttagttttcttaatgattggtaattttaacttttcaaacagcactactccgagttgcttgggcgaattaagattaaattcctctcccgcttcgttgtaaatattggtttcaatttcacttaagcgttcagtaaactcgctttgcatttgatttaagcggttgcggtcaactttaataccactaatttccatcttggctaatacaattgcgagtggtaattcaatatcccaatataaattattttgttcattttttactaattcttggtccaattgtttacctaaaaagttaatagctgctaatttacgtgcaaggtggttaaacaattctgtttggtctggaaccgcacgcttagcgcctttgccataaacatcatcgtctgtatcaatcgcatcgtaatcatgctcatgagcaagttgacctaggtcattagaattatcattagtatctaacaaatacgattgaagcaatatatcaaagttaaccgtcgttagcttaatccccagtcgatgtaagccaacatacgtccgcttactatcaaatacatttatcttaattttgggatcttccaaaatagctttgatttttgaattgttcaacagttctacatcatcactaacccaaatgttatcggcatttccgatcacaaatcccgtaaaatcagacaaatgatagtttttgtccaacatttccaaataaaaatcaatttcaccttttaatgattggagttgttccacgttgtccttatttaaaacgttaaaaacaacctcttttttcacggcctcaactccatcttgagttgccgtttgatctaatttacttaaaaaggacttaaagttcatttggtggtaaaattctctcaaatattcttcgttaataccggcatactgcacatcatcgagactaatttctatcggtgcatcccgtctaatagttgctagatcttttgatatgaaagcattgtctcgatcttcaatcaaatgctccttcatcttgctaggttttaattcatcaagatgctcatacaaattctccaatgaatcaaattgttttaacaacttaatggccgtcttttcaccaactttagttaccccaggataattatccgatgtgtctccagctaagcctttaatgtcaataatttgtttaggtgttacgcctaatttttcttcgacatacgctggtgtgtactcttctacttcgcttaccccttttttcgtaacggcgacgattgttttttcgctactcaattgggttaagtcacgatctcccgtaaccacaactaccacataatcttgggcttcagcttctttagcaagcgttccaataatgtcatcagcttcataattaggaagctcgtaagattttattccatatcctgtaagtaattcacgtaaataaggcatttgctctgatagttcaggtggtgttttagaccgaccacctttataattatcaaattttccatttctaaaagtggttttaccagcatcgaaggccaccaaggccgctgtcggctggtattgttctaaaatactatctaacattttgttgaaaccaaagattgcattagtatgtaatccatttttatttacaaatttacttaaagaattatgtaacgcaaaaaaagaccgaaaagcaatactatttccatcaatcaataaaagtttatcttttgccataatttcctccgttttctatcctctttaatgataccaaaaaccgaaggtcaacgtgaaaaagattgaccttcggtttatttgtatttataaaatttttatttagtctcgattccatccaaaaatagttaagaagtattggaagaggttaataaagtctagatataggctaaatgccccttggattgcaagtccagtctcagaaacttggtcaccatagttcaggtaaagacgtttcatagttgcagtatcatacattgacaaacccgcaaaaatcacaattccaataattgagaagaagaaagttacggctgaactgtgaaggaagaataaattaatcactgaaactaccaccatcgcaatcaatgccgcaattaaatggttacccatccttgatagatcacgctttgtggttactcccatcacactcattacaatgaaaaccgatgctgctgagaaaaatgcccccgcaatagtagcggtactataaagcataaagacactcgacaacgtaattccaaagaatgccgaaaaggcaaatagcattaagaaactaaccgttggattctgcaaggccgccttttgtccaaaaatcataaacaagaacaaagcaataaaaattacccagatactcattcttccttgagaaaggaaagtcattacggctggtcgccagattgtggctcctaggtaagcaatcactccagagaaggctacagcagctgccatccatccgtacatctttgttagaaatcgatttaatcctatttctgtattaataacatttggtctttgatccaatctaattcccccattcgattatttaccacattgtaacaagaagctacccaaatggctaacgttataggtcaaaattagtcaaacaaatcaaaacttaataattatttaaataatgccttataagcattttcgtacttagtaatatctccggcccccatgaagaccaataccgcatcgtgtaaatcactaatagccgataaatcatcttgatgaattaatttggtattattaccaatcttatctgctaagtcttgtgatgaaacagccccggcatcttcacgtgcagaaccaaaaatttcagttaaaacaacttgatcagctaaacttaaactcttggcaaagccatccatcaaagcggcagttcttgagtaagtatgtggttggaaaacagcaacaatttttttatcaggaaattcttggcgagctgcatctaatgtcgccttaatttcagatggatgatgtgcataatcatcaattaaaatattatcagcaactgcttccttagagaaacgacgtttaacaccttgataagttaaaagttctttttgaactaggtccaaatcaactttttcaaagtatgctactgcgattacagccaaggaatttagcacattgtgttcaccaaaaaggttaattgtaaatctacctaacttttcacccttatggattacatcaaattcagaacccgtggttgttcgactaatattggtagcttggaagtcatcattttccttagttccataatagtaaactggaacagatgtattgattttacgaagactttcatcttcaccccaagcaaagattcccttatgaacttgatcggcaacctgctggaaggcactttcaacatcggcgagatccttataataatctggatgatcaaaatcgacgttagtcataatcatatagtctggatggtatgcaataaaatgacgacgatattcatcagcttcaaaaacaaagaatcgtgcatctggaatacccttaccggttccatcaccaattaaataactagtcttgtctaaaccacttaaaacgtgagcaagcaatcctgttgtactagtcttaccatgcgttcctgcaacaccaatactagtgtatttgtctagcatttgtcccagaagttcatggtaacgaattacttttagacccattgctctagcttttttaatttcaggatgttcgtcagtaaatgcatttccagcaatcaccgtcaagccttcacgtaggttggccggatcaaaaggtaatatcttaatgccagcagcttctaagtccttttgtgtaaaggtatattgctcaatatctgatccttctactttgtatccctcgtcatgcaaaataagtgctagggaactcatccctgaccccttaataccgataaaataataagttgaatctttatccacctttaccactcctataattaaattgtttttagtttaccacactacacttcgttattgtttccatcataaaaaacttcccgtggttttgaaccacgagcttccgaaatatatcctgaagcctcaagttgatccataatggttgctgctcggttgtatccaattgaaaacattctctgtaatttagatgttgagatagtttcctcatccgctaagaattcaagtacatcatccattaattcgtcttcgctatccaactcttcactttggactttcaactcattaggattgaaagcatattgtggcgcagcctgtgctcggacaaaatcagtaatgtcatcgatttcttcatcaataaaggccccttgtagacgaaccggattactctttccatttccaaggaacagcatatctcctcttcctaagagtcgctctgcccctgaatgatccaagattgttcttgaatcgacttgactggataccataaacgctacccttgttggaatattatttttaatcaatccggttactacgtccacgctaggtcgctgggttgcaatcaataaatgaatcccagctgctcgtgctttttgcgtaattcgtacaatgtaatcctgtacttctgaagaagaaaccatcattaaatcagctaattcatcaataataactacaatgtacggcatcttattggcgtaatcttgggccttttcggcctttttattatattgctcaatattgcgagcacctgcagccgccagtctttcataacgctcatccatctctttggtaacccattttaaagaagccgatgcggccttaggatctgaaataactggagcaagcaaatgtggcagtccattgtatggcgctaactcaaccgtcttgggatcaattaatagtagtttcaactcttgaggagtcgctttgtataacaacgacaccaaaacactgttaataaaaacacttttaccagaaccagtggcaccagcaatcagaccatgcggcatcttgcgaagatcataagtttgaggttgaccaaacaaatcaactcccaaagccacggttaatggtgactcacttgctttaaacttatctgaactaataatttcacttaaaggcactggtcgaggatgcaaattaggtacttcaatccccacggtatttttaccaggaattggagcctcaattcgaatatccttagccgctaactgcagctttaaatcatccgttaaattcgtgattttattgactttaactcctcgaccgagttcaatttcaaattgagttaccgttgggcccacagtccaatttacaacctcagcatcaacatcaaacgctaataaggcatcattcaatctttgaatttgatcattaacccactcgtccgtattatcagtgtcaattactggattaggtaataaattcaaacttggaaattgatacccgaattcattagtttcacttcgttcaaatgactgccttggattttcttccggcggttgctcttcaaagtgattattattttcaattgggacagctttttcaaccatcgttttcggtacgtttttttctatcaccggtgtaatattttcatcaagttcatgatgacttttctcaagctggtgtcgatgcttaatttcatgcataacctttgctggacgtttcggtgcctcatattttgtacggggcattctaaaacgaggctgtcgatgctcagttttctctaccacttgtttagttggttcaggtgtatctttagccaacgttggttgaatgggttctaccgcctgcgataattttgcttgggaaatggtctctggaacctgtttacgccgtttaatagcaggggtaaaatcctcattttttaacttcgaagtttggtcttcttgaatatttaaacttggattattaaaatctacgcctttttttcgaaaaaaagcaggcccatcatatttaaccatctaaatcccttctttaatcaaagatatgattacctttttcaaaatcaaatgcttcacctacaacgaaatcatcaggtaaaattaatgctcccttcttctgaggtgcattatttaaatgcaattctcttccagaggaaatcattccattactttcaacgccacgaagttcgcctggccaaataatcattccatctggcatgattgctcccaccttagctactactacctcgatattgtcggtcatattaggtgaaccactaacaatttgcaaagtttcaccattatccacctcagtttcagtaattaacaaatgatctgaatctggatgtggtttagttgatttcacgtaacccacgacaaattttggacgttcatctgctactaattcagcttcaaaaccattagcagataatgtggcattaagttgctttacttgttcttgagtcaaagtaatgggacccttaccattgatttcaaaaatttcgctaacatttaagaaattaaaaccggtggtttcatttgttttagcatcggcaattcgaactacggagcctttttgttcaatttttgcttcctcagcatctggacgaatcatcgtaattaggatatctcccatggtttctttattataactagcaattaacattattttctccttaaaatatatactttttaattctcaaaaccttcttactaatgttagaattagtagaaaaggaagtggtttcatgtcatctaaatcatctgcattactcggtttaacgcttaccgcaatcggaacttttgcgctgggttcattagttacatatcaaatcaaggaacaccgcaaagtaagaccacagtctgccttagctcgggtacgacgttcttttgaagacgatggccccattgagggcgcttggattgaatcaaagccgtctcctcttaatcgctatggccttaaagcttcagtttattatggtggaatcaccaagtacgaaaacaatgaacttattcagtacgaatttatcgcagatgcctatactggtaccattatcgatatttatcgtcgataatagcaaactaatagagagtctgaggaaaaatcctcagactctttttatttttcactttagaaatgtgcttttaatttgtaaattggttggcctttagcactgaatttatgttcatattcagtttcaacgttatcttcgttttcttcactattgtgtaagtctaaccaaacgccttcaaaagtcattccatagttattaaggctgtaaagtgaatattcgaataatccttgattatccgttttaaattcaacttccccatttttaactaaaatttgttcataaactttcaagaaagtcttgaaggttaaccggcgtttttcatgacgtgttttaggccatgggtctgaaaagttaaggaaaactttggaaacctcaccatcttcaaaataatccgtaagttcagcgccatcagcatataagaattgcaaattgggaatttcttcctccaaagcattttttaaagcaatggcaattacagttttttgaatttcaattccaataaaattgtattgaggatattttttggccatattaataatgaattgacccttacccgttcctacttcaataaaaattggttgttctttttcaaaccgctggttccattgacccttgaacgcttggcccttttcaacaatcttttctggatgagcctcgattaactccggtgcccatggtttatttctaactcgcataattacctcttaaatttaatttaatttttttatataacgtggtatgaaccacttgagtaaaatcactgcaacaatcccctgtgttaccaccgatgcaactaaaaagttccatgataagttacttatcagtccaattaatgttaaaaatatcgcgcttataagtatgattcttttcataacagataacaagtctttttctgctgcatctgggctaacaggatagatcttaataaatacattttcgtgaacgggacgataaatgtctaccatttggataaccattaaatagattgttagtccaccaacaattacctttaatggaatctgttgactataaccttcaataaccatccctaatagtaatagacgtaacatcaaacccccttgattaccgctccgaatcattattcgggggtataaataagtaaacaaggttggtttcccagataaaatgtgaaccaagccatccgcatatcttcgacgtttaacttctgcaccaacctgcttgacattggtaaacaagctgaagaaatgatacaagcgctgcattcggctattctctaagtcaattgcatgattccagttgaaccgcttagttttgaaaacctgattcaaaagtacaactctaaaaatcaaattaatcgccattaatattaatccacccatcggactaatccaaacacctagtcctacagcaatcaacatcactaccaaatgaaaccacatttgtgaaaggctggtatcaaagtatagagtttgatattttctcaagacatttgccatacttcccaagaaaatagtaaccgtaatggctaccgccgcttcaacatggtgatattccaatgctaataatggaaataaaataatattaccaatcaaagttggcaataccactgagattaatgatcttttgaccgatttccctaaatattgatgaatatctttttctttaggaaccaagaaaactttatccggcagctttagtaggaggacagggttacctagtaaagttagcaaaacgcctccaattaaaactaaaggtttgatataccaggttcctggatggatttcttttaaccaattcgaatatgctaaaccaattccaccaccgaaaaatagcaacgctaaaactagatgatcattcaatacatattttaaatatcgcatgatcattttttgatattgcttagttcgactgttccataactcattcatcgcgctcacccttagcaattgttaaataaatatcatttaaactagagttcggtaaattaaattgtttctgaaagtcagctaacgttccaaccgcttttaattcaccttcatttaagagagcaaagcgatcacaatacttttcagcggtgtctaagacatgcgtagacattagaatggaagctccttgttgctttttttcattaatcacctttaaaaggtcatcaattgctagcggatccaaccctagaaaaggttcatcgactacaaataattctgcgtcagtaataaaggcacaaacaatcatcaccttttgacgcatcccctttgaaaaattagctgggaaccagtctagcttattctctaatcgaaaggtttttaaaagtttatgagcttgctgccatgctttttctgaattcatttcgtaagccttaatcgttagttcaatatgttccttcaacgtcaattcatcatataaaataggtaattccggaatatacgccagcttggttttatattgagtaggattttgttccaaatcaatttcatctaaaataattttacccttcataggacgcattaatccaatgacatgattgattgtagttgattttcctgctccatttagaccaatcactcctagtaattcaccatttttaacttcaaaattaatatcttttatgactggcgtttgtgtgtaaccgcccgttaagtgctcaattgatagtgtcaaatttaaatccccaatcgtctaaaaaagattttgaaaatctccataaattataacatatcggtctttaaccatattgctatgatgatacattccctcctttttcatgtataattaattataaattggaggtagaaataatggatgaaaattgtgtattttgtaaaataattactggcgatattcctagttatactgtatatgaagatgacgtggttaaagcatttcttgatatttctcaagtaacacctggacatactttggtggtacctaaaaaacatgttcccgatctttttgcctatgattcccagctggcagcagacgtcttctccagaattcctaagattgcgacggccatcaaggctagcaatcctgacattaaagccatgaatgtggttaataataacggcgaattagcctatcagagtgtcttccactctcacttccatttgattccacgttataccaaggatgatggtttcagcatgacctttactgataacaccgataaatacagttctgaggaacttcaaaaaatccaaaaacagattactgatcgtttaggtgattaattatggcaaaaaaaactaagaagcattcatggttaaagtggtccatcggaacttgggctggttttaaaggtgtcgaatatcttcttaaccatccccattttatccgtgattttaaaatatcgatgaaggaatactttaccaatttaagtgaatttgttgactcacttcaaagtttaaaggctaactcggctcaactccaagttgaattaaaaaaagctgagcgaacggttaaccaaattactaaatcggtggatcgctttgaatataaactcgaccctcgcattgaaaaaattaatgaactaaaaaaacacataaatagcgaaattgatcatttacaagaccaaatcttggataaaaaaagaaaatgattaaaactttttctaaagattaaagttgttttattatcatccatttaggtatggtatgataggttttgtatttaacaaattaaattgttaggatgtgtagattgtaatgaaaaaagttttaattggttttgccagtattgcaatggcatttaccttagcagcatgtggaaataagacggttgctacaacatcgggtggtaaaatcactcaagacgaatactacagcagcttgaagaacactactagtggtaagcaagttcttcaagaaatgatcgtcaacaaagttttagaaaaacaatatggtgataaagtttctaaaaagacggttactaagcaatacaactcatacaaggatcaatatggatcatcatttaagagcatcctttcatctaatggtatgacaacttcttctttgaagactcagattcgttctaacctgctattgaaagaagccgttaaagctaacgataagatttcaaatgcagaccttaagaaagaatggaaatcttatgaaccaaaggttacagtggctcagattttagtttctaaaaaatcaactgctgaagatgttatcaagaagcttaacgatggtggagatttcactaaacttgctaagcaatattcaactgattcttcaactaagaataagggtggtaaaattgctgcctttgatgacacaaactcaacactggactcttctttcaaaaaagctgcattcaagcttgatgaaggtaaatatacaactacaccagttaaaactgaatatggttaccaagtgattaagatgattaacaaaccatctaagggtaagatgtctgaccatactaaagaacttaaaaaacgtatctggaatgcagatatgagcgatagcacaaccttacgtagtgtaatcactaaagttcttaagaagggtaacgtaactattaaggacaaagaccttaagaatgttcttgacgattaccttggtagctctgctagctcaagtactaaataatgctaaataaaaaagatgaacgatttctcgttcatcttttttatttgctttctggtttataaaaattacgtccatccataccaaaaattcgttcactgaaagctccaggttgtgtatttttcaaagctccagataccatttgaatttcagcatcaagttcgtccaatgcgtgtaaaataactgcttccagcatgtgcggttcaactggtgaaccatattctttcaaaccatgatgagcaacaatcatatgtcttaataccaccattgattcagagctcggatcaatttttaaatccttagctgcttccacaatctcctcgtcgacaatgacaatgtgccctaacaaattgccttcaaccgtatactgagttgcaatgggccctgataattcaatcgttttacctagatcatgtaggatggctcccgcaattaataaagattgatctacttgttcatattgaacagcaaccgacttagctaaattaacaattgaaagtgtgtggaaagccaaaccaccctcaaaagcatgatggttagttttagctgctggaaaactgaaaaattcgcggtcatacttcttcaataaatatctaaccactcgattccaatctggattgttgatttcaaacatcaattgtgtaaattcttctcgcaatttttcagctgaaaccggtcctttttcagtataagcagtaggattgtttggttcctcatcggtagctaaacgcatcgccataatctttacttgtggagcattcttataagtttctctttttcctcttagaagaactactcgcccaggttggaaatttttaaaatcttcttccttagcatcccagtagtttccgtgaatgtctccagatcgatcttgaaacttcatcgaaataaaatcttttccagctttggtcacccgcttttccgcagatttgattaagacaaataattccatttcttcatcattttgaaattcggttatttttttcgtcaaaatatctcccccttttatttttcatttaaattaataattttttggtcatcaattaagtcgtaaacttctttcttggcagaaaaataaataacttgagtttgttctgcaattttttttaataaactaaaggcttgtcgtaaacgaacatcatcgaacgctacaaaagcatcgtcaatgataattggtaatcttaccgtatccgcaaaagcttgcataaaggcaaaccgaattgaaatataaagttgttccattgtacctttcgacagctcaccaatttcaaatacgtttccagcttcatccgttacattaatcatatcatctttatcaaattcgattttttggtagcgttgattagttatctgtctaaagtactcatttgccttatcaaggatcaccggtaaacgtcccttagttgccacccctagtgtttgatcgacccattcagcacctagctgtaaagttaaccattctgaaaccaaatctttaatttcagtttcttgttctgatagtaactgttgttcagctaggatgtctaccctactcttaaggcccgtaagttcacctagttgattagcacgttggtctaaaatatcttgctcagcttgtttaaactcggctagcttttgttcctgttcgttttgaagttgctgcaattttgttaaatctgcatattgttgtagttggtcaaaaaacttaacttggttagattctaataaagtatttaatcttaaatttaaatgttgggctgatctaacttgcttaagccaatcatcaaaatcagcattaatttccggtccattaagctgtttaaattgaatttgcaatttatctagctcagcgcgccgttctgccacactcttattaagtaattgacgctgttggctgatactttgttgctttcgatcttgctcaaccattccatttacttgctcgaacaaagtttgtagagtttcttttcgatgttcatccactgggagaattccatcactgaatttccaaaaggtgtcaagctgttcttcgacttgcgttaagtgtccctttaattcgctcatttcattaaccaaatgctggtaattcaacaagttagattgtaatgctacccaatcttccactggaaatgcgttgaagcttgttttatcaccaatttgcttgattgcggttttaatttgttcagcttcggtttcatcccgcttcaaaacatcttctaaactctcttcatcaggcttaacattgtcagctgatttagcatgggttaaaccatatccaccaccaataattattgctagcaaaattaacttaaataaccagtttaatgggattaaaaaatcaattacgaccagtaccgcggctgcgccaattactacattggaattagaattcgtatgcgttgaacgacttcccgtagtttctaacatttgtgttttaagttgattaatatccgcattcttacgtttctgctttaacaataagtcctttaatttaacaaattgaccttctggcatgggtttaagattaccaaggtcaacttgatactgcgcttgaatttcttcaagttgttggttcaatcgattgaatctatgtttcaagtcctctaactgaccataattcaattttacttctggtagcttactttgtagttcgtctaatttagttatatcaattacattgtttttctcatttggtaaatcctctagctgactttgtaaattacgaagttcattctgattttcacgtatctggttggctaaaacttccaactgattcaaatctaaattcaagtatgcttcggggatatcttgcagcttttgctttaaatccaatgtttctgaatatgtaggccacgtattaatcaaattattggtttcagtaattttagtatttaattttgcaatctccgaccgaacttgctgcaacttttgttgactggcttcttctaagtctttcgttacctgataatctggtagtttggccttatcagcttgaagctgatcaacagcttctttatattgcttgattttaagatctaggtctcgttttcgagaactggcagtatgaagcttatccgcttccttttttaagtcgttttcgagcttaatccactcatcacttccgactgcgcccattcgcagaatatgtcttcgtaaatcatcccggttgcctaaatcattgaagtcgtccaaatcactctggttaaatcccagcaaccgttcgtaagcattttggtcaatggggccaagcatctctgttaaaaattctggattcatttcgagtccatcatccatatttttaacatttactttcccaccatttttacctttaattcgctcaatttggtaagtttttccttgatattctactaccaaattgcctccgtaccctgctgcaccttgtgcttttttaggtacatattgtaaatacttatgattaccacgtccaccagcaaaaccaaatagaatactatagataaattgtcttagcgttgatttaccagcttcattcaaaccataaaaaacttgcaaatcttgtttcaaatcgaaaataacgttattccattttccaaatccataaatctcaatcttattaattttcatcgcgttcgtctccaagagcattccgttgtttcaacattagttcaacttggtctttcaacgggttaagttctaaatcatttccataggtttctgctataaaatcaagttccattaacctgccgagcttttcttgaacttttttttcgttaaaaacattggcggtcgctttttcccagtatgcttggtctaattctgaaaaaatccgaatattattattaaccttcaaagaaattcgataaacccaaaatacctcttggtctaactgtttttgaatttgagttaaaacaattccgctggtaagttcatctaaaatttctggtgttaaaacattactattctgtaggttaatattaactaatttaagttgttgcgctgctaaaggttcgaccgcttgaatgatcgctgaaataatttgttgtaaatccatccctttttgcgcttgaactgctacattagtccattctacaacatcggttcttaagaattggacgtcagtttgcttttgttggttaatggtaactagacttatcccacggggtccaggttcattaatatgacgtccctgagtatttcccgcataggcaatgaccggcatatcatttaaagtttgtcgcttatgaatatgccctaatgcccaatagtcatagtttttagctaacaattgtgaaattgtaaaaggtgcgtagtgggcttcgctcgattttagaccgtccatacttccatgcaacattccaatttggaaatcagcttggttatttttgctaggatattcctcaatccgagcattaatttctgcgcgtttattataactaaagcctgttatatccaccgttgatccatctaccaacgttatttgtttggtttcaactttttctccaaaaatacttacgttatccggaaaaattactccaggtattttagcattaagataatcatgattcccataacttagaaatactggaatatttgcagcatttaaaatttctagttgatcgattgcgaggttcaaagtttccaaatccggttccggattatcaaataaatcccctgtgatgcagacaaagtccactgtattttcaatagctgcctgaaccaagtttttcatggccactccggtcgaactaaccacacgtttacgaatactagccggaatattttttaatccttgaaacggactccctaaatggatatcagccgcatgaataaatttcatatttttcctctactttctaagaaactaaaaaatgggactgcgacatttttttgtcttacagtcccaattttttatagcacagcgtcataacaaaaagattgtcacgtgcgattaattagtttttgtataattcttggatcggtttaacaatgatttgactgacatcgctaaacaattggttcatattacgttctttatccattaaatccttaatcaaatctactttttcaatttgatctgcaatttcatgaacatttttgatttcttcttctgttagttcttcaccgttcatttgtttttgttgaagattactctgaacatcctgaaatttgctatacaacgcactagcatgttcatcttttcgtacttcagcaaaagcttcttgcaagctcttatactcacttgtttggcgaatttcttgttccatttggtttgcagtatcataaatgtttacagccatagtacgcctcctctgaaattaacatcttaattatatcatttaggccttgtttttaatataaaaatcaattcccggtaatgaactttttagcttcgttgaagaattctcccgctttctctttgaccccactagctcctcgagaaatactatctgtgatggaagaagttccgtcttcaatattgtcccaaacgtttgatgtaacattgtttccactattagctagagtagaagctgatttaacgtcaaatgaagtacctttcgtatttggtaaaatggcactcatttcactcttgaacatactattcatgccgactcccgtaatattttccagatgatgggtcttgtttgtgtcatcaaacccttcccaagtagcaactacaacatcctttgtatatcctaccatccatttgtcacgggttgcatctgatgaactagttcctgtatctgcttcagtactacctgttttaccagcaattgtataaccagaaggttctgccccataacctgtgccagaactgtcaccataaacacctaacatcatactggtcatttctttagcgaccttttttgaaataactcgtttggattccgtggtgttatttacgatcgtatttccagaagcatctacaattttgcgaataaatccagtcttcgacaacgttccattattagcaaatgcagtataagcagaagctagttgaattggcgatacaccattcgtcaatccaccaagagccatcgctaggttcttatcatctttgcttgggtttaagccgaatttcttggtgtaatcgtaacccttatctacaccaattttatttaataaccataccgcaggcgcatttttactttgttcaagtgcttggtacatcgcaatctttcctgcatattcgttattgtaattttcaggtttatatttattagttccatatgtttgaagtttatcttctaacatagaactataactatatccactcgctaaagctggggcgtaaactgcaataggttttaaggttgagccaggttggcgtttaatctgggtagctcggttatagcctctaaagacatgattaccacgaccaccaactaccgcttctacaccaccatttttggcatttactgcaacagatgcagcctgtactttagtaccatctgtagcatcaaccggaaaattagcggagttgtcaaaagtatcttgcataccttgctgactatcctgatccagatacgtataaattttatacccgcgattcataatatccgactccgtcaatccatacttgctaatggcttcatcgattactgcatcaaagtagtatggatacttataaccgtcctcactattgtaattatcactggttgagatagctgtttgagcataggatttggcgtcggccttggatatcttaccggtttccgccatcaaacttaaaactacattacggcgtgaaaaggcattttttggatgatcgatcggattatagccactcggattagtcagcatccctgccaaggttgccgcttggggaaccgatagttccgaagcactgaccccgaaatacctctcagcagcatcctgtactccccaaaccccatttccaaaataggcgttattcaagtacattgctaagatatctttttttgaataaacattttcaacttcaattgataaaaataactctttagcctttctagtaaaggtctgttgctgtgatagaaaggcattttttactaattgttgggttaaagtacttcccccaccagatatataatctcgaccaagtaatttattgaccccgtacatcacaaacgctctaccgattcccttaattgaaaaaccatattccttataaaagtttcggtcttccgtcgcaattacggcattttgaacgttaggtgagatattatctagatttgtccaggttcctttttgagaatataaacttccagctttagcattatttttatcataaactaaagtaggctgggataaagctgcttttaaattttttacattagcagtcttcgcttgataagttaaaatcgtacttgagaaaaatacaactgctaaaactactacaataatccatcgcgtaagctgatatctgtgccagtacttatggatgaacgggtgaattttatcccacacgggttttaaaaatgcaccaatcttttgtaagaatgctttaatcgcactccctatttttttcatattcatacatttacctcgttgctgattacgatactttaatagtttatcatatcaatgttattctaccgaggttgattgccctttttaacttcgtcttaataacctattttattctaaaaatgattttaacttctgatgcaaagcttcggccgcttcagcatctgcgctaaatatcaccagtgtatcatacccggctaatgttcccttaactccatcaatttctgcgtcatcgattaccgctgctacccgactaccgtcatttggatcagtttggataatattaataaattgtacttgtgtaataccatttacactttccttaaaaatatcgcgaacgggtccactattatattcaacttgttcttctgcatttaaaactcgataagcgacctcacctgtaatatctgtttttttaactagatgtaactctttaatatctctagataacgttgcttgcgtggttttaataccaatttctgctagtgcatcaattaattctagttgagttgcaatattttttttagaaattaaatttaatatttttttctgacgtaattcttttttcatatcttcacgctccgctcaatatttatataaacgaaattattttattattatacagcactttcttttcttctttcattgctttaattaccgatccggcagtttcactcgtagtggcactcaaaaccgccaaatctttcaaaaatattttaaaaggtaccttcttaacagtaccatgcgtctgcgcatagtcttcatttaaataatctaatacctgacgcacccgttgagctgcgctagaacacgttgttttttctaatagtttttctgaacggtgaaggcggtgctccatccgtctcataaatgccatcgtaaaagcgtaatgatgaacaataattttacgcatctctttgatgggtaaaatgtaaacttctgaggtacacattgcaactgcattatagcaatattttcggccttgcaagatccctcgcagtggaaaaaccatctgcggaacgatatatgagacagaagtcatgtccccttctagattcatcgaaaacaatttaacgtgtccctccttcatcaaaaatacatattcaaattcatcctcctgatcaaaaatccactgtccttggcgaatttttttctttctgatcacctgactcaatcgtgtaatttccgaactaggtaagttagcaaaatctgattgtccttctaagaaactcttaacctctaactccaactgattatttaccatgtttaaattcctccaaataagtttgattttgatgatgtaaacagtctaacggaatcaaaaacagaatttaatatgtaatttttagtccaaatcgtgtagtttaggtccaaaaaggtgtagttcatttgtaaagcgctatcttgattaaaattatgagtattttatgagaaaataaaaagccggtccaaaaaacatcattttgaacgcggtcctcatttataaattacgaaatattcacttttttattttaaaattagttcagttattacatttcgtcaggagcttttactcctaataggcgtaaggattcttctagtacaatacttacactcttaaccaatgctaaacgagctgttttttcttcatcgtcagccaaaattttagagttagcataatatttgttgaaggcctttgctaaacctagggcatacttagcgattaccgaaggttcatattgagcagctgctcgcttcacaatattagggaaatcttgaagagctttcaaagtatcccaagctttaggatccgtaatatttaattgagcgaattcttcgacatcgccagcttttctcaaaatactttcagcacgagctcgactatattgaacgtaaggtcctgtttccccttcaaaacgaacaacatcttctagattgaaatcaaatgaattagttctttcattcttaagatcatggaagattaccgcaccgaccccgacttctttagctacagtatctgcattggctaaatccgggttcttatcgttaatttgttttttagccaaactaaccgcatcatttaaaacttcatccagcaatacaactcgacctgaacgagttgaaagttttttaccattcaaggtaattaaaccaaatggaatatgatgtacatcatccgaccaatcgaagcccatttcctttaaaacagcctttagttgcttgaaatggttagtttgttcagcaccaacaacatacaatgattggttaaaatcataagtccggtaacgatacaaagcagcagctaaatcacgagtaatgtaaagggttgctccatccgtcttcttaattaatgctggatttaaattgtacttctctaagtcaactacttgagctccttggctttctttaagcagacccttgtcttcaagaatttggacaatttcatccatcttatcgttgtagaaagcttcacccttatatgaatcaaatgtaattcctagtttgtcataaatttgcttaaacgattttagcgattcttcacggaaccattgccaaaggttcatggcttcttcatcaccatcttcaagcttcttaaaccagtctcgagcaatgtcgtctagttctggtttttcttggtcttctttatggaaacgaacatagtattcaagtaacttgttaattggatctgctttaacttcctcttcgctaccccaaagcttgtaagctgtgatcaacttaccaaattgagttccccagtctccaagatggttaatcttaattggattgtacccatttttactcataattaatgacaatgagttaccaattactgttgaccgtaaatgtcccattgagattggtttagcaatgttaggagatgacatatcaattggaacatttccttgattaccatcgtcattttgaccatattcagctttttgacttaaaactgtacctaaaacttctgctccaaaagcagtcttgtcaaggaagaaattaatatatggtccagcaacttcaaccttttcaaattgatcttggtcaatcttttcaaccaattcactcgcaatcatttgtggtgctttgcgcaataccttagctaaggtaaaggttggaaaggcgtaatcacccatcttactttccttaggaatttcaattttttcgtaaatttctgtatcagtaagatactcgtttagtgcaggtgctaaagcagcagcaactttcttcttataatccattttttcctccattctgcgaaataaaaaacgccccttacattcgtaaaaatgtaagagacgagatttcccgcggtaccactctaattgattaaataatccacttatttattaaattagcatccataaggtcacgccttcaactttaccttatatctgactcacaccaactcagactcgcttagataagattaaagcctactactaccctactaattaccgattcattatatcagactcttctatgaagttccactacttaattataattgttctagtgcattaaattcagcatctgaaagtgtaatgtaagctgcttggatattactttcaaaatgttgaatgttagatgttcctggaattggcaaaatcacatctgatttttgcaacagccacgctaatgcaatttggcttggcgtagcaagatgattattggcaatttgagataaaatcccatgttcttcttgagctaatctaccagtcgccagtgggaaccaaggaataaatgccatgtggttttcttctgcatattgaagaacatcttcatcatcacgctcaattaaattgtagcgattttggacggatgcaattttagcaacagcttgagcccgtttgatttgttctacggttacttgacttaagccgatatgacgaattttaccttctttttgcatatctgctaaaacaccaacttgttcttcaattggaaaacgaggatcaactcgatgcaactgcattaagtcgatactatcaagcccaagtgtacgtaaatttaactctacttgttgtcttaaataatctggatcacccactacagaccattgattagggcctggacgcgtgaaaccaactttactagcaattagcttatgcggtccttgataatcctttagagccgcttttatatataaattagcgtaaaaaggcccgtatgagtctgctgtatcaataaaattgacatcgctatttaaaactgcttttgccaccgcgactgcattttcttcatccgtacttggtccccaaactcctgtaccaggtaattgcatcgctccaaaacctaaacgatttacttctagttcgctatcaaattcaaatgtttgcttagtcattttagtcctccgaaatgtttactatcctctattataactggttttttgaaaaaaattttgaaaatttcatttgtatataaaaaatttattttcttttcgtcaaatccgaatcttatttttggaaaatgttcctaacataaaaaacgcactatcaactttatatctctatacttatacatagataaaacttagaaagtaggactacttatgactcccaaattaattgctattgatgtagatgataccctgttaaattcaaatatcgtactattaccatccaccaaagatatcattgctaagtgtcttcaaaaccaccttaaagtcgtgctctgttcagggcgtcccctcgctggtgtaaagcctttcttaaatgaattgggtattaccgcagacgaccaatacgtcatcacttataacggttctgtaatcgaatctgtgactggtgaagtaattgcaagtcatgaactttccaactcagtttatcgagcaatggatgaattttctcgaaaatatcacgttgcttataacgtactggatcgtgacagcaatatctacaccagtaaccttgaagtcaatcgttttacggttgtccaggcttgggaaaataaagctggcttattaattaaaactcctgatcaacttcctgctgattttaccattactaagggcatttttgttggtgaaacagcagagttaaatcaagtagaagaagctgttcatgctgcctttgatgatcaatgttatgtggttcgagcagccgataattttcttgaagttatgcataaaaatgtaaataaaggggcggctctcaaaactctctccgaaaaattaggtattcaccctgaagaaatcattgcatttggtgatgagcaaaacgatatcccgatgtttgattttgttggtacggccgttgccatggagaatggttccgatttagccaaatctcatgctgatatgattaccagttctaatgacgctgatggcattaaaaacgccctcgaaaaattaatttttaaataaaattaacacggtttattttttcgatagtgttataatgcaggcgagcaattatatttaactagaaaggattgatcgctatgattacaagtactggtgatttaaaaaaaaggattaacgcaaagactcctaaaattattgtctcaaaagccctactctccaaaaataaatctaacgacgcgaatgcgccttgggttgacgttgggtttgctggattagcgggcatcatcagtactgcatcccttttcttgatgtcctttctatctcaaaaatggaaagcagcttacgttcaaaagaaactgtattaccgatattctgctattttagaagatgaggatacagttactttcaaccttaaaaaataacttataataaaaaccctgctatctttagttgatagtagggtttcttgtttaaataaatctattttgtttttcagtgaagcgaatgacgggaatcgaacccgcgacacaagcttgggaagcttgaattttaccactaaactacattcgcatatgagttaattttagttcaaaaaaattgaattgtaaagttgaatcataaaaaaagagaaacccaactccgccacgagttggatttccctttctcattctctaatataaaattaaaaatttcagtcctaatctaacttattctgatttcgccgtgcaataaccggtaaaatcaatcctaaaataattaatgcaaatggtgtgataatattaagcgctaattggaaccaccagctagttggattagctgcaaaatcagcctttggaataactcctaaaatacatgcaaaagctgtgaaaataaagcaccatagtccaaagccaaaaccaatcttagtatttttaacaaatacgtaatcagatttataattattaatttgtttcatcaataacatgtaggccacaaatacccaaaggtaccgcattggcataacaattgagtttaaattcattaaccaattatacaaatcattcattccgccaattcctaaggctggcacaataataataattgaaactaaaattgcagttaatttgtaaccattataagcaattcctttagcattttttctagtaagaaatgctggcacataattactatccgcatcatttaacaaaattcgtagtggtgcatcgatcgaaatcgctaaagctgccgaattagccaagatattagcaaaggcgtaaatccaagttaatgtattaccaacgtggaattgattacccaaaatttggaaagccgtataagaaccattggccatcaagtcattaggaatatgttgtgcatcaaaaatcattcccatcgcaaaagaacctaaaattgctgatatagccaccatgattgccaacaaaatcattcccaacggaaattctttagctggatttctggttttgttaacgtatggtgaaattttttctgcaccaccaaccgcaaaaactagcattgaaatcgttgtaaagtaattaaaattaaattttggcatatatgtactaaattgatccatgtgagctgtggcaatagctgaatgcgtgataaatggcgctgaaattcctaaaataatgaataaaattgacatgataaacatcgcaattccagcaatactcccaattcggttcagagttgtcactcctttggaagccatccaaacaaatgctaaaaagattatcaaacttaatccttgaacaacataagatggagtttgattaacaaaactaccgttgtttttgaacatccagctaaaaccaatcaaaatagtttgtggcttttgggctaagtatggtacatggaccacccagtatgtccaagccgcaaaataagccagacggctattggaaagttccttcatccatgacgatacaccaccctcagcttctctaaaggtagaacctagttgacctaccatcaaggtatacggaataaaatataatagcattattaatatccatgaaacaataacaactaaaccttgattagcaaaattatttacaacgttgttaagaccccaaactgctgtaaatgaaatcagtgcgatattaaaccatctaaagcttcgattatctttcgaattttccattaacgtctccccctaacgtaaagtaagcgatatcatatagatttatgtttttagtatatatcttccactccaatttaaaaagtttaacgtaataaaaaaacgattaatcatatcgattaatcgtttaatctttaatttgctcttactgtcatactacgatccactcgtgatcgtccggttgcataatcaaattgaacccctggttgtacattccaaacaaaaacgttaaaatttaacgatccatctgttgcaatagcttccgcatggtagccagttggcattaatccatttcctttaaaaacagtcgaaacgcggtaaataacctttttattcttagctaatgcatcccgtacccgttcctcaaaaatttgcatagtctgctgattactgtatgctgtttgagtagctagatttttgggattatctaatgatcctaattcatgagcattgaaattcccattttgatcaaatttaccagtaattgaatatgctagtaaatggcctcggttctgaatttcagttgttttaccgttaatggttaaacgtttttgatgccaaccagttggattccaagtctgactggttctggtattcgacttaactaagtttacacgacttagatatcccgttgcttgtgtcgtccgattcaaacgatctaaattaccgtaaataatttggtttttcttccaatctgcgggattaagggtacttttattattgttaacgtaaatataagctgttccaccggatttaaaagtttgttgagataattgagtatcctcgacacttttaaccgatttagtcgtttgtgggatcccctgactagtcagattagaaacaaactgatgaatatcatttcctttgaaaaaagttcctaaaatggcaattactaaaacaagccaaatactagtagactgcttattttttcttcttcgtttactcatctcttcctccaagttaatcatagtaaaaagttgggacaaactggtttagtttaatcccaacttttatttttactttcttagtttcaaagccatttcgatcgatttatctactaataccgattgtgaatctgcaaccggaaaactgtgatcatgagccatttcctgagcatacgataattcagtacaacctaaaattaccacatcggctccttgttcttctgccatcatttttagaatatgatagaaaagctcagcatcgactagattttgttctttgatatcatcaaaaattaacttgctagttaaatcctgaattgctttagttggtttaacaacttcaaaaccttcagctaacaattcacggtcataaattccatcactagtcgttccaggtgtcccaataatcccgatttttttagcatttggatactgctctttgatatgttttacagtttcgcggggcatatgcacaatgggcacatccgttgctttttgcaaatcatcatagaaaaagtgtgcagtattacaggcaattacaaaaaaggctggattcagcttgctttgttcttgaatgtcctctaataaatctgggtaagggtttggttgcgaatggtccattaaataggttgaacgatccggaactgtagcatggtttactaaaatgtaatttaaataatcttgatcgcgatgggtaggagttctagcatttaataacctaatgtaactttcagttgctggagtccccattccaccaataatcgtaaagaattttttcacaggtcttaccccttattttccttaaaatacttcctaaagttcttaacataattatggttcatccaccacattaataagctacgcttaaagttcatatcctcatcgtagatagcggtaaatccatattgatcattgttaattagttcaagcgccttttgcttatcatcattatttttagcatactttttgaagaccttaactggaacgcccaaccataacttccagttgcctggaacatcattagcgtatacagtttcacgatcagccaacgcattgttaactcggtcttcaaccacccaacgagctaggttgtatccatttaatgtaacaaagaagctactacggccttgacgaatattgatttcaaataatttaaacttaccatcccgactgtcatatttcatatcaaagttggcatatccaacgtaattgatactttcaagaaagtttttaaccgtgtcataaatttcttggttaaattcaggaataattgctacgtagtttccaattgctgatggagctggatcctccaataatggatgacctaaacacatcatttttacttgatgattttgatcaacataagcattcaaaactcgcatgttgctatcatcacctggaataaaatcttgtaaaatcaaatcagaagtatagccattgtcatagattttaccaatgacttcatcaagttctgcttgagttttaattctgaaagcttttttacgaccttcaaaatgaatatcgagccattctacactgtcagctggcttcaaagcaactggaaattcaaaaggtgagatgaatttctcaccactttcatattgtgccttcgtaataaaatgggttgctggatatggtaaattatattcatcacaaattgaataaaaacgttctttattattcaattgtttcaataaatcataatcgatgtagggacagatgaaagtttttgacaactcttctttatgctttgaaatcaattcagcatagccatcgcccatccctagtaaaacaaccttctcgtcagaattttcgtattttttagcaattttacgcattgattcaataaaaacagggtcttctgaaaaaccaggaataatatcaacattcacgattttagtaaaacgtgtgggtgctagcacggtcccggcatacgcttgaacacgtcttcctgtaatttcgtaaaatgaacgagccatcccataagcattaaaatcactacctaatagaattggcgtaaaattgttagttggtctttccattaacttaatcccctcttcacttcttctgctactcccatatcagttggccaaggagtatctacccctccaactttttggtatggatcttcaccttttccggcaagcacgaccacatctttctcactactattcataatcgcttgctcgattgcatcgtgtcggtcaagtacctgacgaacttcaactgtaccaggtttaatattatccataatttgctggataatttgttctggatcttcaaaagctggatcatccgttgtcaaataagcaatatctgcttgttcactcaacgcttgaccgaacccagctcttctcgaaatccctttatcaccaggacttccaaccaccacgataaccttaccatcgtgatattgatgctttaagaattttaatagtgcgtgcaaactagcataattgtgtgcataatctacaaaaaccactccatgtcctggaacatttagatgttccatacgacctggaatcacgattgattttagtggtaacactgcatcctgataagtaacgtctgcaagggcagcagcaataatggcagccgttgcattactttgattgtaatcgcccgccacatttaaatcgtaatcacctgccacgtggaatgcttctgcttttgaactgctttcaaccaaagtgaatcgattggaagtaagatcatcttcttcatcttgaattaagaaatctactccaccattttcaacatctgcactaaacaaataaatttgttccggatcagttgttgcttttgcagcgccaaaaacatcatcaaaacgatctgtatctgcatcaataatacaacgtttagagttaaccattaattgtaatttgcaatgcaagtaatcttcaaaatctttgtgctcattgcgcccaatgtgatccggcgtaatgtttaaaaagattccacaatcaaattttaatccataaacccggtctcttaaataagcttgcgaagacacttccattaccagatatttcatcccattatccacagcgactcgcatatcatggaataaattcattgattctggtgtggttaaatctgatttaaattggtcctcaggcttgggtcccacaattcgatcaattgttgaaaatagagccacttggtttggatacttttgattcaaaattgagtgtgcaaagtaagctgaactggtcttacccttcgttcccgtaatcccgataataaacaagtcattttgcggaaaattgtaataagtagccgaaagaaccgccatggctcttgtaacattcgttacaataatcgcagtcatgccggttccttctggatattcattctcagacacataagtggtagcaccattttggcgggctactgataaatactctggtttgaaatttcctttgcaaaagaacatataacctggctttacggttctagaatcataagatattccagtatttgcaactgttttagttgatttgatttcttttaataaatcatgttctgtaaggattgccttaacagtggcaatttcaaggtccatctatttcatctccacctatacttgagttctcttaactaaatctattgtattagtattggtatcttctgggaagaaaactccataccataaaataaatgtgtaaattgtgaaaatcttttgcatacttgattttccgttaacatgttcatcaagaatatgcattaaagcttctggcttaaagaatttcttagcaatgtctgaattgaaagctgcttcaattcgtttacgatacttatcttctttaatccagttggcgattggagatgggaaaccaagtttttccttcttagctactcgttctggtaattcagcttctgcagcacgacgaagagataccttagtttcttctttatgaattcgagtcttaattggcatggttgcagcaaatttggctacttcccggtcaaccaacggtgtccgaacttctagtgagttagccatactcattcgatcagctttgtgcaagatatcaaatggaagccaagtattgatgtcaaagtattgcatttgagtcatctcatctttgcccttcacttcgtcaaagatatgttgtgtataagctcctgaatcaacattcaaagctggattacgtaaaatttgatcacgttcttgttgattaaatacgtaatttacgcggtaatagcgttcactaagtggctgagccccacgcatcaagaaacgacgtccatggaaacgaggaagacctgaaactgccttagccaacccttttcgaataaagctaggaaccatcttttggtaacgttcaaatgtgaaagcttctagataagtattgtatccaccaaagaattcatcggcaccttctcctgaaagagccactttgacattcttacgagtacctttggaaagatagaataattgcattgctgatggatttgatagtggttcatccatgtagtacatgatggttggcaaaatatcaaagtaatcatcaccatccatgtagagtggtgtattcttttgattgatttccttagcaaattcagttgagtaacttaattcactatacttagaatttctaaatccaagtgagaaagattggataggtttaagtttagcagcttctgctaaaacataacttgaatcaattccactagataagaaactaccaacttcaacgtctgcaatcatatgtgcatctacagagtcactaacaatctttcgaattttctttgaatcttcttcgatagtttgtgattcgtcgatatggtcgtagttaaatttaaagtaagtatgggtttctgttttaccatttttatgaatgaagtaagttcctggaagaagcttgtaaacattcttaaacatcgtttctttagaaggaataaattcaaaacttaagtggattggtaatagttcttcattgaattccttcacaaagtttggatgttctaggaatgatttgatttctgaaccccaaaggaacgttttatcatcatcgtagtagtaaagaggcttgattccaaaatgatcacgagcaccaaatacttcttgtttttctttatcataaattacaaaggcaaacatcccacgaagttttttaagtaattctggtccccatgcgtcataaccatggattaggacttctgaatcaacatccgttctaaattcatatcctaattcttttagttcttcacgaacttgtttgtagttataaatttcaccattgaaagttaatactttagtttcagcactattcatcatgggttgacgtccgtgtgccaaatcaataattgataggcgacggaatcccattgacgcattttcatcttggaaaaatgcttcatcgtctggtcctcggtgtttaattcgatcggccattgacttgattgtgtctttatttacattagcttgattaatgtaaccagcaaatccgcacattttgtaatccccttttatttttcaaatatatacatatcgttctataattccagtaacagataacattttagcaaaaattagaaaccaatactactaccgttaattattcttaaatatgttaactggaaaataaaacgttgcatcaacaattaatcgtgatttcgaattcttattgtttgaacaattcaaccaatctctctaaaatgaagctaactagattagtgtcggatagtaatactttagcctttaagatactacttttaaaattcgatgtacaatttagctctttccaaccttttttggctgaataaaaacttcaagaaagtagtgatttagatggaaaatcgtattaataagtttgatccgtttgctctaattttaggtgttttgtttattgtgattgctattttttcaatcaaaaaccctttatcaacttttaggatggtgattatcatcgccgccattgcgtccttatctacgggattttataaattattttggatccgaccttttcttggtaaaactacttggttgaccctaaatgccgtacttgacatcatcgtcggatttctaatgttattcaatgattcgtttggtatggtctatgtttcagtcttgattgctttaatgtttttaggtgattccttcaccaccctttggctggctaattatattagaaattttagccacaaatattttgttttagatgtatttatctcaatcttaggtattatcctaggaattgttttactattctcaccccttattactgcaatctccatttctatgatgattgctctattatttttgatttttggaatttctttaattatccatgcaatataaaagctggtgtcatcgaaagtattctcaatgattgtttagtcattgtctctgttactttcgttgacaccagctttttagcttaaatttcatatttttcaatttttcggtggtttaatttttgcagttctcgattattttgttccttaaatgtcgccatatagagattaagttgatcaatatcaatcatttgggcttgctcaaataccacccactctacgccctccgttaatggaggagtagtcaatgaacctatgtagcgataaaaataacccctttttggaatcaaatcatctaaaagtatgaattgttccactttattatcatccatagccgttaatattttttcaaaagtagcatttttagcccccaacttaaaggtcacactgaccactaaaggctgtctgaggcaaccataatggacgaagtgggcctctagtactcgcggtgtagcctcacccttaaagcaatgttctgctggatgatggaaatgaacctcctccagctggaagcttcgttgatctgcttccattttcccattagcagttaacgataaactattataatttttatgtaattctgttgcagtataatttttcaacccatccacaatctgatttttcttagcttttaactttgccgtttcaattagaattggtgattgggtttctcgagcctctgattcccactgatcttgttgagtatactttagttttcgcatcatctattcctttcaaaaaaatcaattacagcatcagtatactttttatctaattttacgccagttttttgctcagggtaaatcttcaacgatgtgaatcatttcaccaacacaaaaaaactagaagttaaatttctcaattaatttctagtttcctttaatttatatacgttaaaattatatgccacagacaagattcgaacttgcacatagttgcctatacagcgacctgaacgctgcgcgtctgccaattccgccactgtggcttaacaaacacattttacacctccccttattaaaagggaacaaatattttttctttgtcgcaaaatgagcatatttttactctttatcagtattattagcactggaaatgaccacaaataagatataatatcaataaataagatataatagacacaaggagttgagatgacgtggtaaacacattccaagctaatcggatcgttaaatgttataaatccaacgacctctcgaaacctttcgttggaaaaattagcgatgtgattgataatgatgcaattgtagacattctagactatgatcctagcgaccgttatgccgcttataaagttaattataccgtgcgggttaaaatttgtgatatcgttcccctcgaagttaaacgccatacccaataagcgattattgtggctaataagtcctttaatatgttacagaaaaatcaattaagtatcgaaaaaagaaacaggatttacaatcctgtttcttagtcgtttctatttatcaattaagattactgtaccataaccatggactaccaaaaacttgggtgctccattgacttctactacttctgtattgtactttaagccgataattccgtcgccttcaagcaaatcagctttctttttcaacttttgttttgcttcatcaaatagttgatcaaacatattgtacttatcgatgtcttcggaagctaacatcaagctactggttgcttcaaccacgtccttaattgtataaccggcattgataccttcggttgtgataaacatttatttttccccctgctgcttttcttcctctttttgttgcttagcaaattcttgcattcgtgttcgaatttcaatcaccgcagttacaatcattgaaaataaaaatccaatgacccacataattaccaatggtgccccgctcatgtgcgtaaattccgtcacgagtaccaaaattaccgccacaatcaagggaatcccaattttcaatgtcttcattgctttctcccatttttcttaacatctgtcagtcgagttgagaaatattgaatataccaagtcagaattatcccaacaattattataataataaatttattcgttttactcaacgatgacacccaagtcattatcataataatcgttgataggatcagtaaaattagcgaacttcggtaataagtctttttttgcatgctactattcccctaatacaaatttattaattgcctcagccacacccgtttcataatttcctttagcaatatatttagcatttgctttagcagatgcactagcattggaaactaccacaggaagtcccacactcttgagcattgctacatcattgttattatcgcccaatgccattatttcatccgcttttatacctaaatgccgtccaagttctagactagcttgacccttatcgacaccttttaaattaaattcagtatatcggtctgaagaaaaagtagcattcacatcgaaattaactttatctagtacttctgctttaatctgttttctcttattaaaatcaggattcatcgtaattattttaaaaattggttcatcttttaatgtatccagattatcatgctcaaatctaatggtacggaccccacgactacgaatatattcattatcttcttcaacttcattaaatacataaacatcatttaacgtataaatatgcgtcgaattctccaaatgctgcttggttatatcaaaaatctgagtggcttgctcaaatgaaaatgcattagcttggattacatcaaaattttgattttcgacgattactccaccattatatgaaatcacaaattcatttgctttccctttcaaccccaaagtttctaataaaggttgtaccgattcaaatccacgtccggtattagggacaaacttaactcctttttgagttgcttttttaatagcttcaatgttttcttccgaaacatttccatctggtcctactaaagtttcatctaaatcactaacgattagttttatcataaaattcttcctcacaatctaacatatctctagcctatcgaatttggtagcgcttttcaaataataattaactttttaagtaaaccatttcatttttgggtattcaaatactaagcagttttttaaataaaattcaagcttgttttgcgctccaattctttatacaatatgttgtggctgtttaaagatttaggatttattaatactagatttcggcaaaaaaaaatggaaaagggagcattttatggtgataattacagcaggaatgatcggcgtcggtaaaactacattaacagggaaaattgctgactactatggaacaaaggcgttctacgaaccagttggagacaatcccgttttaccactctattattctgaccaaaaaagttatggattcttacttcaaatttattttttgaataaacgattccaaatgatcaaaaaggctttgactgatgataataatgtattagaccgttcaatctacgaagatgctctattcacacgtgaaaacaacaaagaaggtaacattacggatactgaatttgaagtttacatgaaccttcttgataacatgatgagtgagcttcaaaatctacctaagaaagcaccagatttgatggtctatgctgaaacagattttgataccatcctctatcgtattcgtaaacgtgggcgtgactatgaacaattcgataacaatcctgaattggaatcttactactataagatgtggtcagcttacaagacatggtacgaagaatatgatgttggtcctaaaatgaaaattgatttacaaaagtacgatttaagtaacgaagaaaacgttaaaatcatccttaaacaaatcaatgctaaacttaaagaagttcgggttgaagaacctatgcataaagcaatctaatttaaaatgacctcaattgtcgttccactctagtttaaaactaaagtgccgacaattgaggtcattttgtttatcatttaatttttaacaatcataacgtctgtaggtgaattttcgactacataactagccgttgaaccgataaatacttgagcgaccttgcctaatccagtcgcacctaaaacgattagatcgatatcgtattctttaggcaattcacggcttaacattgatttaggactaccaattttaagggcaatttccacatcttcaacgcctttttcgttagctttttgtttcaaaacttcaagtttttcttccctagaacgaagaatgtcctcaatgtcatcatctgttgaaacaacaccaaagccaagggaaacactctcagtgttagcgtgttgcctttttactacatgagcaataataagttttgcatcgttcctctttgcaacctcaattactcgatcaaaagctgccattgattctggtgaaccatcatagccaaataaaatttttttataatccatattacacaccaacctttcatcttctattataacaatttagcgcttacataatagagttttatgcattttcttcgatttttattttgcatgttttatgctggtttgcggtatactacctttacgaggtgattacaatgttaaagattaatcaggacggattgaacaacttatggcccgtccgttccaatgatagtcacaaaggaagttatggtcggattttaatcgtagctggtaatgatcaatacggaggcgctggaattttatcaagttcagcggcagtttatgctggaggtggattagtaaccttagcaacggataaaactaactttacggctgtccgctccactctagccgaagttatgttgctcgatttcttagattttgatgctttaaaagcagccctaaaaaaatcaacgggagtggtaatcggtccgggattgggaactaatgctactagcttaaaaattttaaaatttgtcttagaccacgttcaaccccaaacacctttagttattgatggttcagcgattgatttgattgctacccatcaaattcaggtagatcatccccaaactatttttactcctcaccaaatggaatggcaacgactttccggaataaagatagtagatcaaaacccctcgctaaatcaacgtgcagttgaccgtttaaaagcaatggtagttctaaagcattatgaaactgaaatttacgctcctcacaccgactttcgccaaattatggctggtaaccctgggatggcaacaggtggttcaggagacgccttaactggagtaattattgcgttagtaaaccaagtcgactctttggccttaggtgttaccttaggaaccttcttacacagttataccgccgatcaaatttatcaaaaagaagcggttgttttgccccatcgcttaattcgtcgtctccccttcacactaaaacaacttcaaaaaaataagctactatgatttttgtcatagtagcttatttttaaccttcaactaaccgattaatttcatcatccgttaattctcgataagttccgggaagtaatcccacatctaattctaaaggaccaaaggaagtccttcgaagagtgaccactttctcacctaggctaccaaacattcggcgaacctgatgatactttccttcttttaggactaccttaaccactgtttgatcatctaattctgaatagtgttcaatgatcagttgcgctggttttaacgtagtaccatcccttaaggtgattcctttttgaaattcttcgacagcttgatcggtgatttttccagtcaccaccgcctcgtaagttttatcaacgtgccgctctggtgctaataaatcatgcgctaactgcccgttattagtgattagcagtaagccttgggtatctttatccaatcttccgactggaaataaatcatttcggagatcgaccttgttgaataaatccataacggttttttgtttacgatcttccgtagcagttaagactcccaatggtttgttcatcatgaaatagaaatattgttgatactcaatcacttggtcttttaatctaacctcatcaaccactggatccactttaactcgcccagttttaacgaccgtatcgttaacaaagattagcttgtctttaatcatttttcgaatttgggttcgcgttcccatattcatgtcatgtaaaaatttatctactcgcatgtctcctcctaactaatctttagcattcgacgtaagccagctgcccgtgcccccacaatttcatccgctaggcggctctttaatacaaagtagagataaaatgctccacctaaaactacggccgcagctataactagtaacgattgtactttactggctggatccatcactatgtataatccattagttacgaccattgcaatcaagaatgttccaaaagcataagtgatgatttttccaataaatgtattaattcgacgataatctaagccatattccaagttgatatgccgtaaaatcaaccaattcactaccataaatccaatagccgttgaaattaatgaacccactgctgaaaataatgccaccatgggaaattggaaaataaatttaacaatcattccgacacagaaatacttcacggctaagacattttcaccaattccttgcataatagccgaaatcactgtaaataatcctaaaacaattgctacataagaattaaattgtaaaatggcagttcctacatcacttagatgatagaacagcgtgtatgctggttgagctaccgcagccatccctaaagcagctggaatcatcaaaaatgcaaagagcaaaattgaatccgttacttgtcgactaatttctgctcgatcgcccctagttttggcttccgataaaatcggtacggaagtgacggccatcgctgacgctaatgaaataacaatcattaccagtttgttagcattaaaagcaaagattgcgtacatattatttaagacggcagtcgaatagtcactcaccgcattcataatccggaaaaaggtgtattggtcgattaattggaaaattgtaatagctgatccaataataataaaaggtacagcttgagcaataatttctttatatagcgttgacgttgaaactaccagttcattggcactatgctgtgacaaataggaaagtcgcttacggtatttaatgaaataaatcccaagcactaataatccacctaatgcaccaataaaagccgcaaaggttgattgtgaaacgccataaacccaatcgccttgaccgctttttcccataataaagtaggcggttgttagcatataaatcactcgggctaattgctcaataaattgagaaacggctgatggtcccatttcttggtaaccttggaaaaagccccgagtcaaactcatcgtaggaattactaacactgcccaagccaacgcatggagaaccgtaattacgttcgggtcaccatcttttaaaaatggagcgccaaaatacagaattgcggcacagataattcccgttccgacggataacaaaagtccccgcttatacaaacgttgccccaacgcaaactcattaattgcgttgtaatgggatacctgcttggaaatcgcagatggaattcctgcaatcgcagcaattagaaagaaactataaatattatatcctttagtaaaaagagcgttcgcttggtcactataaacaccaaaccaaattacccatgggataatataaatggcgcctaatattctagaaaagatacttccggcggtcatccacgccgaaccttcgagcatctttgctttggatgaagattttcctgaattatctcttaagggttgtgaacccatatagagagactctgaattatccacttcagattgcttatccatttataaaaacctactttctctagtcaatctacactattttaatacaattcatacctccgatacaattaaatttacgctgatagctcagctaacacttaaaaaatccaccaaactcccaaaattagttcattttccaaactatttttctacaaaaaaagggtccacgatgctgttaaaacatctggaccctacttttgatttagttagcctactacgatattaacaatcttgttaggaataacaattaccttacgaacagtcttatctgccgtccattgttgaatcttagcatcagctaacgctaatttttcaagttcttctttggcgatatccttgtcaacggcaatcttactccgaactttaccattaacttgtagaatgacttgaactgtagcttctactaacttactttcatcatatgttggccattcagcgtatgaaataccaccttcgtgacctagcaaactccaaagttcttcagcaacgtgcggaataattggagctaacatcttaactaatccttccatatatactgctggaagtttatcagccttgtatgcttcattaacaaagaccatcatttgtgaaatagccgtgttaaagcgcatgttttcataatcatcagttaccttcttaacagtttggttataaatcatatccaaactgccatcattttcagtaacaatatgatcacgcaattggttttcgtcgtcaatcatcaagcgccagacgcggtcaatccacttacgacttccgttaagcccatcttcactccaggcgactgattctgtcagaggtcccatgaacatttcgtataatcgtaaagtatccgctccaaagcgctcaacaatatcatctggattaaccacgttcccttttgacttagacatcttctcatgattgctaccgagaatcatcccttggttaaccaatttttggaatggttccttagttggtacaactcctagatcatataaaactttgtgccagaaacgtgcataaagtaaatgaagtaccgcatgttcagctccaccaacatataagtcgactggtaaccattctttaagtaaatcttcgtcagcaatcttttgatcattcttaggatcaacgtaacggaggaagtaccatgaactacccgcccattgtggcattgtattagtttcccggcgacccttacgaccattttcatcaactacgtttacccaatcatctaggttagctaatgggctttctccggtaccagaaggacgaatatcggttgcagctgggagtctcaatggcaattcatcttcaggaatcaaagttgtttctccatcttcccaatgaattacagggattggttcaccccagtagcgttgacgagagaagacccaatcacgaagacgatagttaaccttcttatgaccaactccatgttcttccaaccagctaatcatggtatcagtagccgtctgcttatccatcccatctaggaatccagagttaattagtccgccttcgctgtccaatactccatcttcaagattgccaccttcataaactggcaccatatctatcttgaatttcttagcaaattcgtagtcacggccatcatgagcaggaacagccatcactgctccagttccgtatgaagccaatacgtagtcactaatccaaactggaattttcttaccattaacagggttaaccgcgtatgctcccgtgaagactcccgtcttgtctttattcaaatccgtccgttcaagatctgatttagttgcaacagctttcttgtattcttcaacggcagctttgctttctggagttgtaatttggtcaacgaggtcgtgttctggtgaaattaccaagtatgttgcaccaaatagcgtatctggacgcgttgtaaatacttcaatttgtttttcgctatcttcaacattaaagaagacgctagcccccactgaacgaccaatccagtttttttgcatttctttaatactatcgggccaatccaccaaatccaaatcgtcaatcagacggtcggcataagctgtaattttaagaatccattgtttcattggtttacgataaacagggaacccaccacgttctgtcttaccatccacaacttcttcgttagcaactaccgttccacccattagatcaggagcccagtttaccagcgtttctttttcataagctaagcccttcttgtagagttgctcaaaaatccattgcgtccacttgtagtaagctggatcagttgtattaacttctcgcgaccagtcataagaaaaaccaagtgattgaatttgacgcttaaagttttgaatattcttagctgtaaaatcacgcggattgttccccgtcttcatcgcatattgttctgctggaagaccaaaagcatcccatcccattggatgaagtactttgtaaccttgcatccgtttcattcgtgacataatatctgttgctgtatatccttcaggatggcccacatggagtccttgacctgatggataagggaacatgtctaatgcatagtatttaggtttatctgcatcttcgaccgtcttaaaagtctcattgtcgctccagaattgttgccacttctgttcgatatctttatgattataagccatagtttcctccattattatatttgtcgataaaaaaaacctaaggattctaaaaaagaatccttaggacgaaaagttccgcggtaccacctatgttttgcaaaatgcacacttgaataccttaacgcggaaaacgacaatctctacttaggttcaagattgttacttttaaagacgagttcgttgaaagtcattccgaatttccactagccattcggtctcttaaaatgcccatcccaactactacttcttttatcgacaatatttagttaggtttatcataccaatctccacgctgcattacaactcaatatgctaaaattaattatgaagttaaaggagaaacgtatgcacaccagaaaattcactcatttattaatcaatattctacctacgcttttatttatcttaatcgtaagtttagttatttttaagcccagctgggtgcacgcttatgacaacagcatcagtagtctggtgcaatctgtccgaacacctggcttcaatcaagtggtcagcatctatactcagttaggtaattctattccttacataattatcagcttgatagtctgcttaattttaattctaaagcacctaaagaaagccgctttattcttggcttgtaatattgtcctcggaaatggacttaatcatttaattaaacaaatcattcaacgccaacgccccgaattccgtttaatcagtattggtggttatagttttcctagtggtcattcagtggcggccgtggttttatttggaagcctaatttttatcactttccaagttgtccatcatcaattaaaacgaaacttactagcattaatctacttaattctaatgttaggcattggcttatcccgaatttatttaaacgttcattttccaacagatgttacagcgggattcttactcggtttaatcgttcttcaatttacaacctatctcttttatggaaggaaaattaaaaatgcttgataatgccatgcaatatagtcatcaattactaacagaaattgtccaacccggtgatgtggtaatcgatgccactatgggaaatggtcatgatactttgtttttgagtgaattggttcaaagtactggccgagtttttagttttgatgttcaaaaagcagctttagagcaaactcgagccctatttgagcaccagcatcatcccttaactaatgttgaattaatccatgctagtcatgatcaaatcgatcattatgtcaccgaacccattactggggccatctttaatctaggatatttaccgggcggagataaatcaatcattactcatcccacttccactatctcagcagtccaacaaagtttagatcagttaaaaattggtggtcgtattatcctagtttgttactacggtcatcctggaggtcaagaagaattacaacaattgctttcatttgtagctggcctcgaccaacatcactattcgtgtttacgctatgaattcatcaatcagattaataatccgcccattttattgtgtattgagcgtaaaaaataatggatttagaagctagcctttcagctaggttctaaatccattttttaaatattatctttggagcgacgatcaaacgcattaatgattaaagcaaccacaatcaaaataaaacaaccaatgtagatattatgcaaagcttgatataaaacatttctcaacgttggtaataacgtttctggtaaagttttagccgtttgagggttgataactttgttcatcatatccatattaattttagggttcgccttaactccggcattcattgttccattcataatgattccgaaaacggacatcatgatggtttggcccagtgtcttagccaaagtattaaaggaagttgctaccccaatccgatctttagttactaattgctgtgaaattactaatgtggaagtaattgtaatcccaaaaccaactcctaaaatagctgcaataaagaagaaagctaagaacggtgttgaagctggtactaaagctaatagtaagctaccaacagctagaattgataaactaatggtcaaaatctggttagcttttaatttaacaatcatccgtcccgctaagaatgaaccaaaaatccataaaattgaacttggagttactgcaaatccagctaatgaagctggcactcctaaaattccttgcgtccagcttggtaagtaaacttcgaaaccaatcaacaaaccagagaccaacatcgtcgccacattttgaattacaaatgtgcggttgttaaacaaatctaggaagataatgggatcttccgctcgtttttcttggcgaataaataacccagctcccacgatgaaaatcacaaacgaaatcactaatgtaacccatgagaatgaactttcgcccatcaattggaaaccgtacattaatcctagtaaagctaccattaaccaaaaactacctagatagtcaattttcttgctatggacactaacttcttctttaaggaagaactgaattaaaaagatggtgataatcccaatcggtaaattgataaagaagatccaatgccaactcagattatcaacaataaagcctcctaatagcggagcaataatagaagcaattccccatgctgaaccatttagtcccattaccttagctcgtttttcaatcggataaatgtcagcaataatggtattagaaaccggcataatcgacccagccccgattccttgtaaggcacgccataaaatcaagaagcccatggagtgggccatcccacttagcatcgagccaatcaaaaaaatgataattccaaaaatgaatactcgtttacgaccgaaaatatcagataatttcccgtaaattggggtaaatattgcattagttagtaagaaaattgagataacccaattcatcaaactaacaccatgtaaatctcctacaatggtcggcatcgctgttgaaacaattgttccttcaatcgccgacataaaagttgcaacaaaaatagcgacggttacaacgaccacatttgtttgttttttctccatttattacctctcaaccaatataatagccgtgttaatatccgtttagacatcaacacagccattaatcaaattttttagtttttaaaaaagtcgtttaaagcttcaactttatccgtcttttcccatggtagttcgacgtcagtccgtccaaagtgaccataagcagccgtctgcttgtaaattggacgtttcaaatctaacatttcaataattccagcaggtcgtaaatcaaaaatctgacgaacggcttgcgttaatttttcttctgaaaccgtaccggtgccaaaagtatccaccatgaccgaaacgggttctgcgaccccaattgcataagcaatctgaacttcaaccttttcagctaacttagctgctacaatgtttttggcaatgtaacgagccgcataacttgctgaacggtccaccttagtcgcatcttttccagagaaagctccaccaccatgacgagcggccccaccgtaggtatctacgatgattttacgacctgtcaaaccggcatccccttgcggtccaccaataacaaagcgacctgtaggattgatgtaaaaattagtattttcatctaaaagagtagctgggattaccgctttgataacttgttcaataacatcttggcgaatctgttctaaagtaacatcaggatcatgttgagtactcaaaacaaccgtatctacgcgaactggatgatcattatcatcatattcaaccgttacttcagccttggcatctggacgaaggtaactgataacttgttccttacgtagtttagcaattctttgcatcaaatggtgacttaacataattggtaatggcattaattcttctgtttcattagttgcgtatccgaacattaaaccttgatctccggcaccaatttggtttagtcgatcttcatgaccttcacgcgtttccaaggaatcatcgaccccttgggcaatatctggagattgttcatcaatggcaacaattacagcacaattttcgccatcaaatccatattctccacctacatagccaatatccttaatggtctttctaaccactttttggatatcgatgtaggctgttgttgagatttctcccacaacgactaccaatccagtcgtaacggttgtttcacaagcaactcgcgcatctggatcgttctttaatagttcatctaagatagagtcactaatttgatcggctatcttatctggatgtccttcagatactgattctgaagtaaataaatgtctttctgacatgtaaattccccctaaatttaatttcggttacaaggatcttttggataactaatcctatcgggaacgctagtaacttattaagtctatcacacccactctttcttttaaagttaggttgacgttccttcagcttttgtatacgattaatgtcaggaaacataaggagttttatatgaataaaatcaatctaccaaaatttaattatcatattgaaaaaaagagctatctgcctgctattaatgctttgttactctcggtagtaccttggtatcttagtagtcattttagttcagaggcctttagtaaacatctatccatccaaatattattttttctagcaacttttatggtaaattttcttattatcgatcgtctaaccaacaaaactaatctacgtttaatggcacctctggcgattattccaattttgacctttgtaattctattattcagcgaaaacacttacgttgcccttttaggattgcttagttttgtgccatttctgactactttcctaccatttgaacagaaaaatggtgtaggattacttactttttcacttagtgtcggaacgttagcaccgcttgcctttttctacattcgaaatgggtttgtaacttcgatcctcttgaaaatgggcttattactttctttaatgattatcgtaattctctttgctatttttattaaaactagttttaagtttgcgatgtttgctctagcattaactttaatcattacgatttttgcttttattcttttaaagagttggacagctttaatttatcctattttagcagtttttagttggtttgttcctaaattacatctacctcgaaactttacattgctagtcctaattgctctaattggtttggcttcaatttttacaaccatcaattaatttcttaaccaaataaaaacggacgaaaaatcagtctttgattttttcgcccgtttttttgtatctaaattatgcttcttctagtaattttctgaaaggaattagtgattcagcatgatacttcttaacaaattgttcaactgtttcagggtcttgagtttctttatccaaaagtagttgttcaactggaagtggtcttaagtttgtaatcttaacatcaattaccacgggtcctttacgatctttcgctttttcaaaggcttgttccagctcgtcgtaggtccggacttcaaatccttctgcccccagtgcttgggctgaagtaccataatctgcatcaatcaaatcaacaccagaatgtggttgcttgctatcatcttgttcagcttcgataaagcctaagctttcatttgttaatataacattgatgataggcatatggtacttaacttgagttaggacatcttgcattaccatggcgtacccaccatcacctgaaattgaccaaacttggcgatctggatactcagcttgtgctccaatagctgctggtaaggcataacccattgtggcataccaacctgaggtcgtaaatcgttgtgcttgatctgctttaagaaaacgcatgccatcgattgttacattaccaacatcaacttggaaaatagcgtcatcggttgctaaagcgttgatcttcgcaaaaacattttcaacatttaaaggtgtatcttgttgacctacaaacgaattcttccattcttcccaattctttttattttctaatgccgccttataccatttgctttcagcagtagtttcagccttttctagcatcagtttaaggaatttatgagagtcagctaagatagccaaatctacaacatgtcttctaccaaatttacttgcatcaatatctacttggatatattttgcatctggggcaacaaagtaaggctggaatggaaaatcagagcctacgaacattacagcatctgctgcttgtaaaatttctacccctggtttagttgctactcgaccagctgatcccatgttagccttataactgtcggggacaattcccttagccaaggctgatgtaacaatcggaatatgcaatttttcagacaatgcgataatatctgccccagatcctcttgtaccttggccgatgtacatcactggatgcttggcatcactcaaaatttcaagcgcttcgtcaacctgctttacatctgcttcaggtaagattggtgcttgataaagattagctgatgaaacatagttatcttcaatggcttgccaacctaaatctttaggaattgtaacgaccgctactccactatatttgtaggcttggcgaatagcttcgtcgacgacgtgtggcatttgttcagcagtcattacggttcgattataaactgcaacatcagtgaaaataggattttcatttaattcttggaaatagtccgtgttcattaatgttgtaggaacttgtccgaccaaagccaatacaggcgtatgatcatgcttagcatcatataaaccgttgagtaagtgaactgcaccaggtcctgctgaaccaaaagtaactccaagtttaccagttaccttagcttctccgactgctgctagcgctccaacttcttcatgtcgaacttgaacataattaatagtgttcttccgattgtacagagcattcattgtcgaatcaaaagatccccctggtagaccataaacgttatgaactccccatgattccaaaactttaatcattgcatcagatgcattaattttttcagtcatataatcccctcattccacttctttttagtaagttatttacaaggttcattgtagttctattcaattcatttgtaaactaaaacgacattatttgttaaataaatagtacttatttaactttgcttaatttatcaggatattagactgaatttaattgaaagttctctaaatgcagttcaagcttactttagtatcttaattatttttatatacaaaaaaacaccttattctaaaataagatgttttaattgtttttttctacttgtgcgaacgatttgtaagaccctacactattgattgtcaaaattttgttcagttttcaaaggtctactatcgttgtcatatcaacgctgttagcgcttttgacaactatttaactatatcatcgagatcaattactgtcaataactttttttagcaatttttcataaatctaattcgatgactgccgcgaactaacgctgctagaatataataccaattttacccgtgattcgtcaatagtttattttaaaaaagtaataattacttagtaaaggattagaaattgatttgttaacgatttcatgaagctaaaaaaacatctttttccttgcgtaaaatgcacaaaaaaagaatgagaattttgctattctcattcttttcttagttcttatttagtcgatgggtttcatcgttgggaacaatagtacatcacgaattgaaggagcatcagttagcaacatcactaaacgatcaatcccaattccaagcccccctgttggtggcataccatattcaagtgcttcgatataatcttcgtcaataccttcagcttcatcgttacctgcttcacgttctgcaacttgagcttcaaaacgtgcccgttggtcgataggatcatttaattcagtaaaggcattgccatattcattacctaagatgtacaactcaaatcgatctgtaaaacgatcatcttcggcgttcttcttagctagtggagaaatttctactggatgtccgtaaataaacactggttgtttcaattggtcttgaaccttttcttcaaagaattcattgatgatgtgtccaactgtccaccaagactcgtagtggataccattttcatcagcaagtttcttcgcatcttcaaccgacatcttaggccaaaagtccactcccgcatatttcttgattgcatcgaccatgtgtagacgttcaaaatcttgacctaagtcaagttctgttccttggtacgtaatcttaccatcatctgaaaccgctgcaactgctgccttaaaaattccttcagtttcatccattacgtcatggaaatcaaagtaagctgcgtatgtttcgagcatagtgaattcaggattatgacgagtatcaatcccttcatttctgaatacgcgaccgatttcgtatactcgttccattccaccgacaattagccgtttcaaatgaagttccaacgcaatccgtaaatataaattgatatctagggcattatggtgtgtaataaatggacgtgcactagctccaccagcttgagtatgtagcactggtgtttcaacttcggcaaaatcattaccatcaagatatcttcttactgctgaaacaatcttagtccgttttctgaaacgatccatactatcatcattagcaattaaatcaagataacgttgacgataaatttgttcaacgttttgtaaaccatggaacttgtcgggaagaggacggagcgctttacttaagaaagttagtcccgttactttaattgttaattcacccatatcggttttcatgacatccccagttacaccgaggaaatcaccaatatcagaacgcttaaagactttgtatacatcttcgcctaaaacatccttacgaacgtacaattgcatttttccagaacggtctttaagatctgcaaaaccgaccttacccttaccacgcttagagatcatacggccggcaatcgtagctaccacgccctgttcatcaagctcttcctttgtcatatcactgtacttttcgtgtaattgtgctgctaaatgtgttctctcaaaacgatgaccaaatggatcgatgcccttatcacgaagttcttgcatcttttcgcgacgaactcttagttggtcattcatacttggttgttgcttttcacccactattttgtccccctcttaaatttattcaaatataattattacctactaaaacaacaaattgcaaccttaattcaaagttcttactcttctagtttcgagtttttcaataaaactatcaaaaatatcaatcatttgttgctcagtatctgctcccgttacagccaccttggttcgagctgaatgtggaatacccttgaggtagtaggcagcttgtccacggaattctcgcggaccgacattttcacccttcaattctactagagcgtgtaaatgctcttttgcaatctcaattttttctcttggtgtaggttcatcaataactgttccatcatttaaataagctgaaattcgttgtaattcccatggattacccagtacagcacggccaatcattaccgcgtccgcaccaacttcatccaacattcttttggcatcttcaggtgtccgtacatctccattacccataaatggaatatgcaactgacttccaacttcttttaaaatattccaatctgcttgtccagtatacatttgtttacgagttcgaccatgcatagcaagtgcagaagcacccgcacgttcggctgccaatgcattttcaaccgctaaaatatggttagcatcccaaccagttcgcattttaaccgtcactggttttttaaccgcatccgtcacgtaagataccatctcatataccttattaggatccagcaaccaacgggcaccagcatcagtattaacaactttgtttacgggacatcccatattgatgtcaataatatctgcatcagtattttgatcaacaaatttagcagcttctactaatgtttccttagtgccaccaaaaatttgaatactcattggatgttcatttggatcaactgtcatcatgctcagagtttttttgtttccatagataattcctcggtcggatatcatttcgcaaaccactaatcccgcaccgaattttttacagatcattcgaaaagcagtattagtcacaccggccattggagcaacaactagttgatttgggattgtaatgtccccaattttccattccattttttcacctcgtcaaactttttatgcatgcagaatataatatcacagaaattcatgattgtggagaagcttaccaatttcacttatttttggtcaatgatttcttggagatccgcttccgaaaatacatacttattaccgcagaaacgacaaaccgcctcagcaccatgatcttcttccatcatttctttgatatcttgtaatggtaatgctgaaattgaatcgccaaaacgttctttagaacaatcacattcaaatttaacatccatcttgtctaaaaatttaatctcatcatcattgaaaatatcttttaaaatttcctctggtgttttaccagcacgtagcatttccgaaactagtggaatttctttcaaacgttgttgaagtttatcaatagcatcgtctgtagcatctggcataacttgaatcaagaagccgcctgccacccccaccgtttcgtcaggattaacaaatactgatacgccgacggcagaagggatttgttcagattgggctaaataatacgtaaaatcgtccccgatttctccagaaactaagccaacttgtccagtaaatggatctcctagacccatatctttggtaacagccattaccccagcattcccaactgcttgccccacatcaatatgatgatcttcttttaaaggtaatgaaacatgggaattctgaaggtagcccttgaccgttccgttcgcatttccatcaatcacaatcgttccggtagggccgccaccattaattttgacagttaatttttcttcgccctttaaaaccgacgatgataataacagcgttgccgttaaagaacgtcccaatgcagcagttgcggcactccaagaatcatgacgttgttgtgcttcttgcactaaattagtggtactaaccgcgtaggctcgaaacattccatcatttacaatacttttaactaaataatctttcattttatacccgctttcatcaaaaaatcgtgagtgcattttgcaacccacgattcttaaattattgattttctgaatgattgttatcgtcttttggataataaacagtcgtagcagaatcactttctgagccgtcatgcttaactgccttagcagcttcatcataacgttcagcttctttacgttctagttctcgtttagattcttcgaacgttgcagctttttcgctcggaaattcagaagtagttttcttttcaggcatcttgcctgtcttgaataaactaataatttgcttttcatcaagtgtttcatgttcaagcaatgcttccgcaataatcttatgttgttcacgatgctcttcaataatcttacgagcttcgttataaccttcagtagtaaagcgccgaatttcttcgtcaattgtcgcagctgtcttttcagaataagctggtccaccttcaccatagtaggattgccccggagcagccaactcgacttgaccaattttttcgctcatcccatactgagtaaccattgctcgagcaatttgagtagcttgctcaaagtcatttgatgctccagatgattgttggtcaaagatgatctcttctgcagcacgaccacccatcaaaccagcaatttgttccatagcatctttcttcgacattaacatctgatcttcacgaggaagcatgatggcataaccgccggcacgtccacgaggaacaattgtaaccttgtgaacaactcgtgcatcgtttaataccaaaccgacaattgtatgtccagcctcgtggaaagcaactgtctgacgttccttcttgctaaccactgcgttcttcttcgctggtcctgcaattactcggtcttcagcttcgtctaagtcagcagcatcaatcgtcttcttattacgacgagcagctaacaaagcagcttcattaagtaagttttccaaatcagctccaacaaaacctggtgtttgtttagcaatttctgctaaatcaacatcactatcaattggcttattcttggcatgaactttcaaaattgcttcacgtccattaacatctggacgaccaactaagatcttacggtcaaaacgtcccggacgtagtaaagctgggtctaaaacatccgaacggttagtagcagccataacaatgactccttcatttcccgtgaacccatccatttcaaccaataattggtttaaagtttgttctcgttcatcatgtcctccgccggtaccattgccacggcgacgacctacagcatcaatttcatcaatgaagatgattgatggagcatttttcttagcttggtcaaacaagtcacgtacacgacttgcaccaaccccaacaaacatttccacgaaatccgaaccagaaattgaatagaacggaactccggcttcaccggctaccgcttttgcaagtaaagtcttaccagttccgggaggtccttccaaaagtacccccgctgggattcgagctcccaactgaacaaacttacgtggatctttcaagaattcaacaacttcaacaagttcttgtttctcttcttcttcacccgcaacgtcagagaagcgaactttatttgcactcttatcagcaggtttgaccttggatttaccaaagttcatcacccctttacctccgccaccttgaccggcttgacccatcatcatgtagaagataaagataaagaaaattaaaggtaagcccgttactagtaattgaacccagaaactgcttgattcttcttctttagttgtgaccttaactccatcagctgaagcagatttagttatttcggtaattgttgaatcattctgtagaactgaagtttggaatccagtcaccttattagatgaaacggttcctgggaataatcctgctgaagaatcatccttttgtgcagaacgatatttacctgtaaccttataaactccattggctggttgaatatcaaagctcttcacgttgtcttttttaagttgtgagacaaattcgctagacgaaatagtagaagtttggctattgccaccctttccaactacagccgcgataattcccataatactcaaaaaaactacgatatagaaaagactatttttaaacaggccatttctgttatttttcatgtagttcctccttgtaaggcatcaagaaatatcagttacaatcttgaccattgacgatataataccatatttgactaactttgaccaatgattttattcgtaaacttctggcttcaaaactcccacataaggtaagtttcggtaatagccttgatagtctaatccataacccactacaaactctttaggtacggtaaaaccaacgtagtcagctttagcttctacaacacgtccagctggcttgtctaagaaggtacaaatcttaacgcttttcgcattgcgtgaatataataaatccacaatataacttaatgtccgcccagtatcaacgatatcttcaataattaaaacatcgcgtccattaacatcttcagataaatctgacaccaaatcaacagttcccgttgattccatgccacctttgtaacttgaaacatcgataaaatcaatttcagaatatacatcaaattcacgaacgacatccgttgtgaagaacatagcacccgttaatacacttaagattaaaggacgttttcctgcatagtcctttgttaattgtttacctaaacgttcgcaagcttcctttatatccgccttactgtacaaaactctggcgatatcattgtccatggggacttcctccaattctaaattccataataaattgttgattatcttttaggaaaggttcctttaaccaggcctttcgcaaacctggtacccataaaatttcatcatcaacatccgtaattgcaaaataacgttctcgttgttcattcggaaccttttgatcaattaactctcgacgaattgttttataaccaccatttttaagtcttaagcggtcgttggggtttattttccggataaaaagcgggaacctcagctgattggcgctcaaaaccatcgtctcgtcagcatccaaagccgacttttgattagataattggaattgagcatcaccatctaaatttaaccacgaattcaatgttaccacacgcttttttacttgttcaccttttacggttatttttttaccaattcgtagataattgtacgtgatttcaaatttatagttttttccaatgtcgattgtagcttgagcttgtttagtattattaaccaatcgaactagctcacccaacttattctcatttattgcaatttccgcattaacttcagtaataatttttaaaataatttttttctgccatgggagcgattctttacgtagcgccagcagatcaaagctttcatctctttgtaacttagtaagtttttcaagaaccacttggtcgactaagttagactgttctaatagctgatcttgatagtgctggatatgttcaaccacccttggattttcttttcgaaaagcaggaatgatttcatttcgcacacggttacgtaaaaattcagtagtacggttggtttgatcttcaaaccaccgtaatttattttcttgagcggtctcgatcaaaaattgcttagtaaattttagaaacgggcgaattagccatccttgtgcaaacgttcgccgttctggaattccatttaattgatttagccagcccccccgaatcacttgcattacgaaattttcagcttgctcatccgcattatgtgcggtcaatagtacttgcgcctgctggtcatgcattacctgcttaaaaaaagtatatctaaattcgcgtgcagcagcttctactccatgttgagggtgctgacttttaggccagtccgtctccataaacgtgatttgatgctgtcgacaccatttatgtaaaaatcgttcttcttcaatactttgctcacgcagctgatgattgacatgggcaacaatcaattgttgatgcttaattttagttgaatttatcaatgcgttaattagcaccgttgaatcgactcccgttgaaactgccactacgattttgaattggctcagcccatattgttcaacaatctgatcacctagctcaccgattttcatagttaactacggcgtccgccacgaccaccacgtttaccatccgtattacgttttaacgttgataagcgtgactcactatcctttaaaaatccagagagcatttgatcaaaatctggttccacatttgagctgcgttgttcacgatgattatcgcgatgactgtgttgattatgtgaatactttctatccatgtttcctgctggacggccatggaaatttccattggaatggtgggaagttgaagcaactttagcagtttctttttgtacgggatgatccactgcctttctaattgaaagagcaatctttccatcgtccgcaatcgataaaaccttaaccttcacggtgtctccaacattaagtacatcatgaatatccttaataaaaccgtcagaaacttcactaatatggactaagcccgaacgattctcccccaaatcaataaaagctccgaaatttgtaattcctgaaacttttccgtctaccttagttccaacttcgattgtcataaatacctatgatcctcctaaaaaatttaatgcttaattataccatcccacaccgactccttgcgagttttgttcacgcaaattcagtccattaattaacaaaaaaagcattaagatgacctacgtcatttcaatgctttaatctaattttattttgcatcatttggcaaattatagacagtttcaccttttttagtatagagatatttagaacgaatcaatttttccaaatattgttcatcgttcatctgcttaactttgactttgagcgccttgttatcattttgaatcttttcataatgcgctgtttccattgctaatttattattaacgctacttctggaaatatgtgcatggacaatttgaaaaataaaaatggtcgcaataatcgcgaaaacacctaaaataaatagtgctcgttgtttacgggccctagcatagggatttactgctcctgtcgctgttcttgctttcatacttctcttatttttcttcacattttccattaaaataacctctcaattatcttaaattataacaacgctttctttaactgtctatcatttttaacttcttaattattttctaaaatcttgttcgtaattttcggaaacgatcgtgtacatccgttctgcatcatcttttttcgtagtatctaaaagctgatcaactttaattaccaacgttttatttccaaaacgaatttcaatatggtcgtttactcccacattagttgaagatttagccactttatcattgatcaagattcgtccttgatcagctacttccttagctaaagcacgccgtttgataattcttgaaacctttaaaaatttatctaatctcatttaacaatcctctgtaccattcttaaaatttttgaaccatagggaatagtcaaccattcccgaatactaaataacctgaatttaaagatataactaataaaaacacctgctccaacgattacacccattactgtgataatagtagcgccgaagcgtcctggagaaactactgttaattgtaaaacaatcacgagtaattttactactatgaacattaacaaatttccccagatgagtttccttaaaaagtgatgttctcggtaaacccgtttcgacaactgactcggtaatgcataattcatcacacctgcaatcacagctaagcttaatactgtcacgagactagctcctaagattcccaaccattgagtagcccaactatttaaaacaactttaattataattcctgtgataatggccaccaaggtcggtttaacagcccccgcactttgcaagatgctgttatacacaaagattaatgcagcaaaaatcacacttaaattgtacacagctagagctaaggaaccttccgaactgccaaatagcaggtgattgatttgaggcattaaagccaccattcctatactggcagccatcgatatggttagtgaaacccgcaatagtgaggttgctgatcgataaaaggcttttgtgtcccttttttgtaaagcctccgtaagagatggtagcaacgtggtggcaaaagccgtagcaatcaccgtccctaattgaactaacggctgtgcacgatcataaatccccttcatcgacttagccattgattgagttagcccaccactgaccaaactatttttaaccgtgaacgaatctactaactgtagcaaaataatcatggctgccaataagcaaattacgccaccttcaaccacaaagcgtttcactaaaattttaaacagttgccaattaaatttatgtcgtttagcttttattaacttggacccaaactttataaaaaagagcgttgaagcaacggcagctaaagttgaactagccatcgcccaagtccccattttatacacggaccaatttagtttaaccgccaataccgcaactaaaataatgattgaaacccgcactacttgttcaagcacttgtgatttagccgtcggcgccacatcataaattccttggtagtaaccccgccccgtcgccaataatggcataaacaggaacatagtcgaaaccattcgcaatagtggggttaaactaacatcccccattgcaccagcaatccacctagcacctaccattaaaaataaaaatattaacaatgatagccctgccaaaattagcatcgcatagcgacttaaacgtaaccttttttcttcttcgggttcctcagcaataatttttgatataaaaatcggaaatccatttaatgcaaaggtcattccaatgccataaattggatagatttgttggtatacataaaaaccagtattaccaactaaattttgaaggggcactcgatagactgcacttaaaattttagccacaattgatgcgatggataaaattaatgccccacgcataacctttttagcactcgaatttttcacaatcagtcctcacacatattctttaagtttctcaatataattaaacagctgtgtaaaccaatccttttgtgtcattcgtggttgaattaccagcttaatatgcattttagcatctgattccgctaccgtcgctcttagtcttgtaactgataatgcttcaaatatctgctcaccagttaatttttggctggctgcccttgtcatagttacagttaaaataccgtccttgcgggtgattctttcgacttgaacttgatcggctataattttcaagtcggtaatttgtaataaattatcaacttcagctggataatctccaaagcggtctaacatatcatcttgaatatcaacaacttcttcatgactgttagcctgacgtaatcgtttatagaattcgattttctgctgttcatcttcaatataagaactaggaagaaaaccttcgattccgagactaatctcactatctgaacgccgtttaacctttttaccttgcttcttcttaaccgcatctgccagcatttgtgagtataaatcatatccaacagaatcgataaagccatgttgttgttttcctaacagatttcccgcgcctcgaattgataaatctcgcatagcaattttaaatccagaacctagttctgtgaaatctttgatggcttccaatcgtttttcgcctaattcagttaacactcggtttttctgatacaagaaatacgcgtaagccacccgtgatgaacgcccaattcgaccacgaagttgatataattgggaaagtcccatatgatcggcattttccacaaaaagagtgttagcatttggaatatcaattccggtttcaatgattgtcgttgtaactaacacatcgtactcacccgcaataaattcaaacaagatatcttctaattgtttctcggtcatttgtccatgaatataacccacccgggcttctggaactaatgcttcaatttcagccactactttttcaatatcttgaactcgattatgaaggtagaaaacctgtccattacggcgcatttctcgcataattccttcacgaatagcccccgcgttttcttccattacatacgtttgaatcggataacgattagttggcggtgtttcaatcactgacaaatctcgcaccccaatcatggacatgttcaatgtccgaggaatgggggtcgcggtcaaggttaaaacatccacctgtgatttaagctctttaattcgttccttatgtttaacaccaaaacgttgttcctcatcaattaccagtaatcctaaatctttaaattcaacatccttagataatagtcgatgggttccaacaatcacgtctacactgccatcttttaatccctcaagggtttccttaacttgtgccccagtttggaaacgagacaatattcccgttgcaattgggtatccttcaaaccgttcattcatcgtatcaaaatgctgttgcgccagaatagtggtgggaactaaaatagccacttgtttaccactttcaaccgctttaaaggcggcccgtaacgcaacttctgttttaccgtagccaacatctcctactagcaaacgatccatcgggcgttctctttccatatctttcttgatttcttcaatggaccgtaattgatctggagtttcagtatatggaaaatcattatcaaattgacgttgatagctgtcatctggtttaaaagcaaaccctttttcagcttcccttttggcatacagttcaattaagtcatcggcaatgtcttcaatcttagaagcaacgttcttcttcgtcttagcccagtcagagccacccagtttatttagtttagggcttttaccttccgctgcaacatatttttgtacaagatttaactgtgttaccggaataaataattgaccactccctttgtactggatggtcatataatcttgatgaacgccatcgacttccatcgtggtcattcccataaactttccaatcccgtgattgacatgaacaacgtagtccccagtttttagttctgtatagcttttgagacgttcggcattttccacatgttgttggcgaggacgttttttaggaaccttagcaaatagctctttctccgttaacactaccaatttcgtactaggcatatcaaagccttgtggaaatgattgtccaataatgttaaccgctgccatttgaattcgatcagcattaactttttgagcagcaatctcaaaatcgtgaagcacttcggtaatttttccttgtcgttctttggaattggcaaagattaacaccgtttgcttacgagctaaccatcgttccacctcaccttttaaaacaggcatttgtccaaagaaatcttggacagccctagtagtgatttccgtcaactggtcaaactttaagcgccccatccctttttggaacatcgacaaaaataactgaggaacagactttttcttgatcaatgttcgaatatcgacgccaaaggattcgttatctaacaacacgttattttttaactgatcaacgatccaactggcttcattattttcaatgtcagtttcagcatccaagatccggggatagtcgtctaaaactagcgtgccctttgttagataatctagcaatgaagttttagctgcatacaattgtttagcgtacattgtatcttcttgaatcagttggtggtgtttccagcgctcgattacttcattaatattttgttgtaaagcctcaaagttttcttcacttaattttttttgagcttgcgccagctcgttattcatcgttttaattgcttggtttaattttgtttcatttattatcaagtctgtagcgggcaatacttcaattttttcgatattttcaatacttcgctgggttgcttgatcaaaagttcgcagcgaatcgatttcgatatcaaaaaaatccattcggattgggtcatcttggttaagtggaaaaatatcaactactgaacctcgaaccgcaaattcgcctttcttttccacctgttcaacccgttggtatcccagcgcattcagatcgctaattaaagtttggaactcatattcagcccccacttccagagtgattcgagcttcaataacatccttaggttcgggaactaatcggcgtaaaccggatgtagaagtaataaaaatacccgtttttgatgtcgctaaagcacttaaaaattggattcgtgccgtacgataatttggcgaactagtggccacctcggccgcaataatctcttcagctggaaaccaatacgtatcaatctcggactgttcttctttaaacaagttatagacatgttcggcccgcgctaagctatctgttacatataaaattggggctgatttagtttcaataatcgtacttaagaaaagttgtttagccggctctagtaaaccggtaactaattgccgcgtccctttttggagtgcatcaacaacggttgtaactcccgaatcagatgcaaaaatttcatttatattcatacttgctcctaaataatcctagttgtatttattcattagctgactgaaattttcaattgtagtccaatcttctaatgctgctactgcattttgaacaccaatttcaaaatcggttatctgttccttcctaaacttacctagtacgtaatccacgacgctttctttagtcggatgatcaatccctactcgcactcgattaaaggattgggttcctacatgggctattatacttttaatcccattatgtcccccggctgagcccttttgacgaagtcgaattttaccaactggcatatccatgtcatcataggccacaatcatgtcatttaaatcaacatcgtagtaatccattaaaggacgcactgctcgaccagaatcgttcatataagtagttggttttactaacaaaactttttcaccatttactcgaaaatctgcgatcaaggcatcactttgaactttaaaattatttatatcatgcttttttgctaattcatcgacaaccataaaaccagtattatggcgcgttttatcatattctttaccaatatttcctaaacccacaatcattttcatgttatttttccaccctcaacacgcaaaaacggctgaaagagcaaaaacccctcagctgtccacgtttattttcatgtaatattaccatattattgaccccaagcgggtcttttaacctctaacttatcaatcactttactaactatacccgaacttcataaaatttttactcaactttcttttatgaaaatgctatacttagtattgtttgataaattcaaatattatatgaaaaaaggggattgatcttttgtctaaaattcaaaaccatcaaaaagttgtattagtcggcgacggcgctgtaggttcaagttatgcctttgcaatggcacaacaaggaattgcagaagaattcgtaatcgttgatgttgttaaggaccgtactgttggtgacgcacttgatcttgaagatgctactccatttactgcacctaagaacatttactcaggtgaatattctgactgtaaagatgcagatcttgtagttatcactgctggtgctccacaaaaaccaggtgaaacacgtcttgaccttgttaacaagaacttaaacattctttcaacaatcgttaagccagttgttgactcaggcttcgacggtatcttcttagttgctgctaacccagttgatatccttacttacgcaacatggaaattctcaggattccctaaagaaaaggttatcggttcaggtatttctcttgattcagcacgtctacgtgttgctcttggtaagaaattcaacgttagccctgactcagttgatgcatacatcatgggtgaacatggtgacagtgaattcgctgcttactcaactgcttcaatcggtacaaagccattgcttgatatcgctaaagaagaaggcgtttcaactgacgaattagctgaaatcgaagacagtgttcgtaacaaagcttacgaaatcatcaacaagaagggtgctacattctacggtgttggtactgctttgatgcgtatttcaaaagctatcttgcgtgacgaaaatgctgtattgcctgttggtgcttacatggacggcgaatatggtttgaatgacatctacatcggtacacctgctgttattaacggccaaggtttgaaccgtgttatcgaatcaccacttagtgatgacgaaatgaagaagatgacagattcagctacaacattgaaaaaagttcttacagatggtttgaaagctcttgaagaaaaataagcttttcaacatcaactaatttcaaatagttgaaaaaacgactctgaataaatattcagagtcgttttttatgcccaatttactaatttcacgcttctaacattacttcttcataaaaagatagcatttcttctgatataataagtaagtaatatttaccgtatgcaattaattactggataataataactgattaaatattttgaagatagcaaacacttttaatgttttagttatttaatttttctatatattctctcgtcattaaaaatcaaccactccatgttgacctatatatttctatttactaaataaaaatatataaataggcttgattaatattctttattacagtaatgttacagaggataaaatttatttcggaggctcacgatgcaacgtagatcaaatcatcttaaaaaaacaaggaaacttccttacataatacttggtgcagtcgctgctgtgctagtcttaatttatgcaggaggagcaatctactacagtacttccaacacattcatgcctaatactgtaattgatggcgtaaatgttgctgggaaaaatgtaaatcaggcacaaacgctggttaacaatcatgttaaaaaccaaacttttaatttaactgaaaaaaacaaagttctcaaaactgctaaatatgcagatgcaggtttaacctcttctgataataagactatagctaagcttctcaataaacaaaatgctttaatgtggcccctacaacttgtccatgccgctaatgctgataacacagtaaacgcaactagcaaggctaaattagaagaatttgctaaaaaaacagcgattactttgaataagaatcgtaatactggttcagcttccgctattagtgccactgaactggctagctcaagctctaaaaaaggtaataagataattagttctactgcgcttgcagaggaaatcaaaaccagcatcgcaaaaggacaaaaagatattgatttaaccaaaacatatcaatcagctactgttaattcagatgatattcaaaaacaaattaaaaagtatacagcagaaaaaattacttataacatcaacggtaccaatgtcactattccaagtgatactttaaagcagtggatagttcttacttctaaaaacgacggtactcaaactgtttcggttgataatgcccaagttaaagcctatctagatgacttaaacgataagtattctacctatggagctagtgtgacctttaatagtactaaacgtggttctcaaactgttaaaaatgaaatttttggttggactattgatactaccaccgacgcagctgatatagcccaaaaaattgcaactggtaaagacttcaccgaaaaagctacaatttcaggttctggacaatctcttaaaaaaggtgaactcggatcaacgtatgtcgaagttgataaaactaaccaacatatgtggtattacaaagacggcaagcttaaaatttcaactgatgttgttactggaatgcctgcaaataatgatgacactccaactggtgtgttctttgtttggaataaaaaacgtaatgctaccctaaaaggtaaaaatacggatggctctaattatgcctcaccagtcagctactggatgccaattgattatactggagttggtctccatgatgcttcatggcaacctaaatttggtggagattggtataaaacccatggttcccatggttgtgtcaacactccacctgcaacaatgaaaactgtttatgctgaagtagccctcggaacaccggtagtcgtgttctaaattatcattttgtgttattattaaatttgtattaaagaaaattgcggttttgggaggaaattctaatgcttttaaaatcaatggtcaaacctaagaaagatttaacaactgttcgtgaagatgcaactcttgaagaagcgcttgatattcttgaagaatctggattccgttgcgttccagttttagataaaacgggtcgcttgttccgtggaaatatttacaaaatgcatatttatcgccacaaatcacgcggtggatcaatgcaagaacctgtgacttctcttttaaaaaatgccactaagtatattaatgttaatgctgctttctttaacgtcttcttctcaattaaggatttacctttcattactgtattagatgataacaattacttctatggaattttaacccatgcacgtctcttggatgggttatctcaatcgtggaacgtaaatgttggtagttatgtgattactgtcatttctggggacgaacgaggcgatttagagacgattgcaaagatcattactaaatatacctcaattgctagtgttatctctttagacgttgaagagggggatttagtgcatcggatgatgttcactctcccagcaagtgttgatgaaaagagattacatcaaattattagcaacttagaacgtaaaggcttcagagttcctgaagttgaaaacctaaaacaagatcgtttatagttcgtaaataaaaaaggattcgcagtttgcgaatccttttttctatcttgaaataggtggttttaaaatttgagcgtgaaactttgttcacattttctattctatgtattcggtacgagacctatacttacctttaaggcctcgtccacctgtttcatcttctggtcatctaatcgaccaattttatcatgtagacgttgtttatcaattgttcgaatctgttccattaaaataactgaattacggcctactccttgttctccacctttaattcctacatgggtaggcatcttaggcttagaaattttagccgttattgctgcaataatgaccgtcggactatagtgattaccgatgttattctggataacaagaaccggtcgcatcccgccctgttcagaaccaacaactggtgacaagtctgcatagaataaatcaccgcgtcttatcttcgactcgtccacagtgtcaccccattaacttttaatttaaaaaatttaacttagtaacgttcaagcacatgcttttcacaatccgcttcacatgaagaaaagtcatgagtaatttcggaattgatatcagccatttgaaggtatccggctttaagctgttcaagatgctcagttgcgtgacgggtaaaaaagctccttacaatatcatcatttacacaactaggttcaaaaccaaacatttcacagtaagtctctttctcaattgacatatcttttggttgaatactcattagattgctctcctgtactatttaattattaacattattttagcattcaatacattaatttactacaccattttcagtatagattcgtggtaaacgttgtgtgaatccacatgtgatttcataattaatggtcccagcatattcggcaatgtctgtcatggtaattgatttttcgcctgattttcccgctaaaattactttagttcccacaggatatgactttggtatgcgaaccatcatttgatccatacaaattcgtcctactatttcgcaaaattgaccatcaatcaaaacatggaatccttgtaaacgacgttcataaccatctgcataaccaatcgggatcgtcccaatccattcatcttctttagctgtataagtcgctccataactaattgaacggcctttttgcactagtttagaaaaagatagttcagactccagactcatagctggctgtaaatcaaaagggctttccagtgtttttccagaaggattcatcccataaatgccgactccaaaacgaatcatattaccattacaagctgcatgccacaagctggtagcagtattagaaacatgcacataacgtggacgtcgagttaattggctgatgaaatggttaaaacgttccacctgtaaattgaaataagtcgtatccttttcatctgctgttgcaaaatgtgtaaacacaccttcaaaattgaactgttgactttgttcaagataatcggccgctttcttaaaagaagctccatcttgaaaaccaatccgtcccattcctgtatcaatacctaaatgaactttcagcggcttttgatctagaatttgcgtagcttcatctagccatgcttgatcacccaccgttaacgagatatcattttcagcagctaatttagcatatttaacatctgtaattcctaaaactaggatagtttctgttagcccagcatctcgcaaagccaacgcttcgtctaagatagcaacacaaaaaccagttgccccagcttgtttcgtaaatttggctgtttctacaattccatgtccatagccattagccttaaccacggcaaataattcactgtgtccatctaatcgactaatctcattttttacattatttctaattgcctcagcattaataactagcttgctgggacgatgtatccctacaaccatttcaattatccccctctaaaattacctgtgttacaacatggtggtcagaatgggaaattgacacatgtacggttccactaaacggatgtttaacaatcttaggttttccaaccccatcgtaattaatttcgatgtcttgaaaattaagttttttacctaatcctgtcccgtaagctttactatatgattctttaaccgaaaagtgccctgctaaaaattcatacgcgcgttgacctttcttagcttcaaactcatcaaattcagtgggcgtcaaaaccttttggataaacgttgctggattgtggagagttttaaatcgatcaatgtttgttatatcaatgccaattccgtaaatcatcctagtacctccaatgtcgttcctattgtatcaaaaaaagaggtcaagaaaaaatgtattttccgggccccttagtttattgaaaatgtttatttttctttaattacaaattgacggtttgatccacccttgttacctgagttgcgatcattacgcttaccaccattgtggttacggtcatcgcgaccaaagcgtgacttgccgccacccttacgatcgttattccatttaccaccacggcctccgccattgctactattaccattactacgacgaccattaccaccacgacgatttccgccacggtatccgccgccacctttaccgcctttgttgccaccttttttacgaggaagtgggcgttcaggagtaatcttaactttgatttcactagcgtcagacttagttacttcatttagaagtgcagcaaccagcgttttagcatcatgttgttctaaaagatgatcaacttgttcttcgaacttagcaacatctgttttttgaaccaattcttcaatgctttgttcagccattgcagcacgtccagcaaaagcttcttcttctgttggtggcttcattggtaacaaacgtttctttgtcaaatgttcaacgtcacgaagatagtccatttcccagttagtaacgaaggttactgaagtacctgtagcaccggcccggcctgtacgaccaatacggtgaacataactttctgggtcttgaggaatatcatagttgtaaacgtgagttacaccagagatatcaagcccacgtgcagcaacgtcagtagcaactaaaatatctaattgtccttcacggaattgacgtaaaatactcattcggcgttgttgagttaaatcaccatggattccagcagcattgtaaccacgagtaactaatcccttagaaacttcatcaacgcgacgcttagtacgaccaaaaataactgcaagttttggtgcttgtacatcaagtacgcgggttaaaatatcaaatttttcgaattctttagaacgaacgtagtattgatcaaccaaatcagcagtaagttctttagacttaactgtaatttgttttggatcagtcatgaacttaacaccaattttcttaattggtgctggcattgtggctgagaacaataatgtttggcgttcgctaggtgtttgttcaataatgtgttcgatatcaggtaagaatcccatatctagcatatcgtcagcttcatcaagaactaatgttttaacgtggtctaaacgaattgtctttcgaccaatatggtccaacaaacgaccaggtgtaccaaccacgatttgtggatggctctttaaagcattaatctgacgacggatatctgatccaccgtaaaccacttgaactttagcttttttatattttcctaatttaaagatttctgcttgtgtttgagcagctaactcacgtgtaggtgagataataattgcttgaatgttaggattatctaggtcaacattttgtaggattggtaatccgaaagcagctgtcttaccagtacctgtttgagcttgtccaatgatgtcttttccttctaaaacaccaggaatagtttcagcttggataggtgttggttcgtcatacccattgtctaaaactgcttttaaaatgtcttcgtctaaccctagttcggtaaatttcaaatataattcctcctaaattttcgtcaccgcatcaaagaaaatccgtccttttagggccgcgcccacggtgacaatcgtgtaaacataactttataatcatacacccctgcttagggattagcaaacaaaagttcttgaaaacgctgttaaaacagctctatttggcctttttaataaaaataaagttgtgatatttaggctagcattccccactcaaaggtcggcaaccgcgttttaagaataatttacatacgctgtaaaaaatctaaaagccacatcacaactttaatttttaatttttaattttatcaacaacattttctaaatgaattccgtgacttgcttttaataaaatactatcatctgcttgaatttcagttgaaagatcatctgtaagtcgctttaattcgccagtttcataataatgaacagcatctttactgtagatatcttcatcaatcagtcgtttttcaagagctttcatatgtgggccgattaaatatacttgcgcaaaacgcttggcatttaatttttcagctaagctagcatgcatttgatcagcattctcacctaattccaacatatctcctagaactaccaaacgacgtccttcagtatttacgttagcaaatgaatccaatactgctcgagcagcagtcggattagaattataaacatcacttaaaatacgttcgcctttttttccagttaaccactctgttcgatttttggttaaatcaaagtcaactagcgcttcagcttctttttttaggtcaatatggtacttatgtccaacggcgattgctgctaatgcattagttacattgtaatcaccaagtactggaattgttacggtggtttcttcatccaaattagttttgaacattgtacttgtgtcagttccctggatatcgctggcgctgacatcattatctgctttaagcccaaaacggtattgttcaacattgaggtctttagcacgctgttctaatagcggttcatccccgttaaaaacaaaacaaccgtcctcttttaggccatctgtaatttccatttttgcatcagcaatccgctcacgcgtcttaaaaaattcaatatgggcttcgccaatcatcgtaatcacagcaatatcaggttgaaccaattcacttaaaaagtgtaactgtcctggacgatccattcccatttcaactaccaatacttccgtattagagctcattcccaaaatagtaattggcacgcccagttcgttgttaaagtttgctttagtttttaccacattatattctgcttccagaactgctgcagtcatatccttagtagttgtctttccattacttccagtaatagcaactaccttagggttaatcttatccagataatatttagcaagtttttgcagagcttctaatggattttttactagaatacttggtaaatcagctggacgccgttcttggtggtcttctgcccataaagttgcaacggcgcctgctgttactgcttgactaataaaatcatgtccgtcacgttcacccataattggcacaaaaagtgatcctggagataattttcgactatcaaattgaacactcgttacgctaatatcgttccatagttcaggatattcatccgttccaagagcgcgcgcaatttcgctaagttgcattttcatctttttaaaactccccttaaattaaaaaacctggctacaattataccataatagctcattaaattaacttaccttaaaagtagactaaacatcttatccccaaaatgattacccttttttgctaaaaaagagaacttatatcttatctgacacaagttctcaatttaatataatgcatccgcatcaaaggcttgcgggttagtaataataaaatgccaatgtttactacgtagattatatttcaaaatcgcaatttgttgggcattattataaagtgaatctttgctgcgtaacgtaggagccaaattactgtcgctagcaatcaaaatcgggattcgatattcgcgatcttgctcaaaagcttgatcaaacgcaaaaattaatccttctcctaacacaggaattaattgtcgaaccattccagctggtaattcagcaaatttatttccccgacgaaatacaattcgatgctcgttataagcttgttcagcatgacgaataatagattgattcaaaactaaataaaaattttttagacgacgataataggtcttcacctgattttcgccaatgtctaaataaacatagtcgttttggagcttatacgaaaatggcgtatcattatgagttttcatatgccccatatataaaaggttagcaatatcagccggcgtgagctcactcaacgcatctcgctgagaaaaatcaatccaattgcgtgggccatggtttcccattaaatactcactaacttttttagcgccattaatttcatttaaaaatgtatgattatcaatcgttaaatcatcactgacttcccgatttaataataaaatattggttggtatttgcaagactccctttaggaaatcatttgccgtaatcccgcgcgaataaattaaattaacaattgattctaaatgtacaaaaatatagtcatcacgcatgatcccataactctctttcaattaactatatacttacattctttccaaacgttgaatgcgatcttcaattggtggatgcgtatcaaatagatgtgccatggtacgtttctttttaaatggatcagagatataaagtgcagcactacttggatcggcttctttcatcggttcactgaccgatatcttttgtagagcatggattagccccagtgggttacgtgttaattcaacgctagaggcatcggcgagatattctcgatttcgtgataaagccaattgagcgatagttgtggcaattggacctaaaataaccaatacgatggaaataatcatcatcacaatttccaaacttccgccttcattgtcattatcattgcgacgtcgtcccccgccccaccaaaatgagcgcattccaatatttactagcattgcgatcgccgaagataatgccaaggcgatggtcgaaaggcgaatatcataatttcgaatgtgtgaaacttcgtgtccaattacgccttcaagttcttctcgattaagccgttctaaaataccagtagtcactgctacggcagcatttttaggactatttcctgttgcaaatgcattagggctggcatcgttaacaatataaaccttgggcattggtatattagctaccaaggccatgtcttctacaatatgccaaatttccggatgatcgacttcactaatttcagttgcgtgattcattcccatcacgacgttagtagaattggcaatcatcatggccatataaatagcggcaattactgccgccataataatccctgccattgcactatcatagaaaacataaccaactgcagcaccaataaacaatactaagatagcaaaaccgatcatcacataaacggtctttcgcttattacttgcaatctgttgatataacattaatcgacctcttaattatttatcaaatgaaacggttgggtttttagtttcttcttcaggaacttgaagataatcaaccggcttaaatccacccatcccagcaattaaattattagggaaagattgtagtttaatgttgtaacttgctacactcgaattatatagttgacgagaataagcaattttattttctgtattagttaattcttccattaatttagtaaattcttggttagccttcaagtcaggataactttcagataaagcaaaaatgcttttaagtgagtcactaatctggttagaagttttcataatctcttcacgttgtttagtagaaggggctgaattatcagtctgatccactaattgattacgaagtgccaccactttactcaaagtatctttttcatgggctgcatatcccttaaccgtatttacaagattaggaatcaaatcatttcgacgcttcatttgaacgctaatttggctccatgattcctgtgtataggttctagcttttaccaagccgttgtacattgagacaatcgcaattacaatcaccacaattacaattagtgctattatcattcctaccattcaatcccatcctttcaaaacttcctatatatgatattaatagtaacaaattcgtcaagcaaattatatgaatttgaacactaaattttcttaacgattaaacttttctgaaaactctttttgaactgcttccggagccttggtatgactcattttcttgataaatttagcccgaatcatcaaacgacccgctcccgtatcatcacaggtaaccagcgttaaaattttcttacctttaatatcgtcaactacttgcacatcggtcgcctttataaatttacgggtgtctacccgatactcataaatattggtctcatctgtcaaataaaccttttgcccaattttggctttccaataaagcggactaaataaaacatttttatcaaccatatgatgtccagccaatgcgtagttaccttcacccattcgctgattttcttttaaagttcccgccgccaacgccaacgtaagattatcgacccctttgccgatcggaaggtgtatgtttatatcagggtaaacaatttcaccaatcactttaattcttttctccgaagtccgtgcctttagaaccgtctgccaatccaatgattttacttttgtatagtcaaaattggctttcttttcagtgtttttagcaaccactttctcgttcacctctggattatattgtgctaccatccatgttttgatttgacgattaaaaatcatcgctaaacttagtagcaccaataatgttaatccaatcgaaactaaccaattttttagttttttactcattgacttttgctccattactatttttaatttttatggtattgtatattggtatatcttttttgaaagagggctttttatgatgtttttcaatcgaaaaggacaatctagaaagaaacgtgaaccttgggaacaaaatctttttgtgctttggttcggaaccttcatagccggggtcgcatttagtgagattatgccgtttttgtcgctttatgtcaacacactcggtgacttctcaaaatcgcaactatctttttatagtggtctaacttattcttctactttcttaattttagcaattatttctccaatttggggaaaaattgcggataagcgtggaagaaaagtaatgattttaagagcttcactcggaatggctttcgtcttaggcgcaatgggccttgttcaaaacgtctttcaactgattggccttcgtttattacaaggtgtttttgcaggttatattagtaactccaatgcactcatcgctaccgaaactcctaaagaaaaaagtggttatgcacttggtattttatctactggtcctgtatccggatctctactaggtcccctcattggtggtgcactagcttctattttttcatatcgagtaactttctttattacaggtggtttattactaatcgtctttttcctaagtttcttcttggtacatgaacacttcgttcccgtagaaagtgaatctggttcgctttctgctcgagaggtaattggtaaactaaatcagcctaaggccgtattcggcatgtttatcacaacgatgattattcaagcatctaataattcaatcgcgccgattattagtttatacgttaaagaattaatgcataatggggctggtgtaacaatggttgctggtttaattgctgcaattccgggaatcgctaacatgttagcggctccgcgcttaggagaacttggggaccagattggaaccgaaaaagttctttctgtggcctttctcttcgccatggtattctacattccaatggcctttgttccttctattttttggctaggagttttccgcttctttatcggaatttctgatggagcgatgctaccagcggttcagagtattttatctaaacgaacacctgctgcggtaactgggcgtgtatttagttggaaccagtctttccaagcactcggaaatatgattggcccattactaggctctgcagtctctggtttatttgactataacgctgtctttattgctacttctgtattagttttaattaactttatcttattccgttggttaaacggacgatcagtagcataaatcaagttagtaacgctgtgttatgttgattactgagaagcaatcctaaactatatttcagactacaaaaaaagaggtaccactgataaattcagcggtgcctctttttgataaccaatggttataattaagccaaaccgtactttttgttgaattttgcaacagtaccgtctgcttgttggaacttttgacgtcctgtgtagaaaggatgtgagtcagatgtgatttccacacgaatcaatgggtattcgttaccgtcttcccacttgattgtttcagctgaacctacagttgaacctgacaagaacttaaagccagttgctgaatcttgaaatacaactggatgatagtctggatgaattccttttttcatgatattacgctcctttgccatgagtcatttgctgagtcatagttatttattataaatcaacgtccccaataatagcatagaaaaacaacttaaacaaggtcgattaagattttttactaccattaggacctaaatttaaattctttaagttagcaataaacgcttcgttgtttttagtgtttttcaataacttaagcacttgttccgtatactccagagcatctccacgcatcgaccggcgaatatcccaaagctgattaagtatatcttttgagaccattagttcctctttacgagttcctgactgacggatatctaacgccggaaataccctgcgctcagccaaattccgtgataagactagctctgaattacccgtacctttgaattcttcataaatcacatcatccatccggcttcctgtatcaaccaaagctgtcccaatgatggtaagtgatccaccctcttcaatatttcgagcagagccaaagaattttttaggcttataaaacgctgccggatcaaccccaccagaaagtgttcgaccactaggggaggtcactaaattatatgcacgggttaatcgcgtaattgaatctagtaagacaacaacatcttgtttatcttctactagacgaagcgcccgttgtaatactaattctgaaacacgagtatgattccggggttcttgatcaaaggtggaataaaccacttctcccttaatcgagcgttctaaatcagttacttcttctggtcgttcgtcgattagtaaaacaatgagcttcacatctggatagtttgtggtaatcccattagcaatagcctttagtaaagtggtttttcctgctttaggtggtgctactaccagaccacgttgtccaaatccaattggtgaaaacaaatcaactaatcgcgttgataaaatattagaagttgtttctaattttaattgttgattggggtagatgggggttagagctggaaaatgaggacgttgcttagcttcttctgggtccttattattcactgaagtaacccgcattaatccataataccgttcacctggtttgggatggcgagcttcaccaccaactaaatccccattacgcaaaccgaaacgtgtgatttgcgatgctgaaatatagatatcttcttgcgaagaaccatagttgattggccgtaaaaaaccatatccatcatttccaacgatatctaaaacgccttccatttcaacaaatgacttctttttagcctgagcacgcaaaacagccagagacaattccttcttgttcatctggctgtaatatgaaatcttatattcacgggcaaggccgtatatttctttgagagtcatttcttgcaagtcattcattgttaaaaaattatccatcgacttaactctcctatatctttgactacaatgtattgtcggtcgtgattgaaacatccgctccgagcttagttagttttttaaccaaactgtcgtatccacgtaggatgttatctgctcgggtgatggttgtagtgccttgggccataaaggctgcaatcattaaacaagcccctgcccgaatttctccagcctcaacttcagcgcccgtaagtttttcagaatgattaatataaatcaccccatcagcatgtttaatcttagcacccattttttgtaattcaattacgtgtttgatacgttctgggtaaatatgatcattaacaacactttgaccagttgcttttaatagggaagccgtcaaaggttgttgcaaatcagtcgcaaatccagggaaaggactcgtattgacttcaattgcttttaattgatccactttaggaacaaaaatcttatcgccatcaattttaatatcgacgccaagttcaagcatctttgaagtaaacgattctaggtgttctggaataatattatttaccatcacaccatcccccacagccgtagctaaagacaaataggttccagcctcaattcgatccggaataatggtatgcgtagctgtagaaaccaacttatccacaccttcaatccggataacatcagtccctgctccacgaattttagcccccatattatttaaaaacattgctaaatcaataatctcgggttcacgtgctgcgttttcaatcgttgtaataccttgggccttaacggcagccaaaataacattgatcgttgctcctacagaaaccacatctaaaaagatgtgcgctccatggagtccacgatcatatgctgaaatgtacactgtatcttcatcttctgtaacgttggcacctaaggctttgaagcctttaatatgctgatcaattggtcttggaccaatattatctccacctggaaatgtaactgttgaacgcttgaaacgaccaagtaaagagcccataaagtaatatgatgctcgtaagctcttaattgccttactaggcaatggattctcaacaatttcagttggatcaatcaccataactccatcctcaaacgttgaatgaacattcatcgattcaaggataatcattaagttatgcacgtcaagtatgtcgggcactgaatcaaaccgtactggagtatccgccaaaattgcagccggaatcaacgcaacggtactatttttagcaccaccgatagtcacttctccagacagtcgctgtccacccttgattatcatttttttcatggtttttcctcacaaacgaactttaagtactttaaaattaaggaatgtattttacagtcaacctcaatcataaataatttgttccaaaaatacaacctcatgaacgcaacaaataaaaaaatagccgaaaaattcgactatttttatgcttatttatttgcagcagcgataaatgccttaaataatccttctggacgttgtggacgtgataaaaattctgggtgatattgagctgccacgaagaatttcttttctggtaactcaattacttctactaaacgattgtctggtgaagttcctgagaatacaagacccttagcttccatttcggcacgatagtcattgttaaattcaaaacgatgacgatgacgttcttcaatcatttcttggttgtcataagcggcagcagctacagatccttctttaagcttgcatgggtaaagaccgaggcgttgagtaccacccatatctttaacaccttcttgatcagccattaaatcaataatgttgtgcttagttgctggatccatttcagccgaattagcatcttggtaacccaatacgttacgagcaaattcaacactggccatttgcattcctaaacaaattcctaagaatggcacatcattttcacgagcatattgaatagaatgaatcattccttcaatcccacgatcaccaaagccaccaggaacaatgattccatcttgtccggcaagttgttcagcaacattttccttagtaagtttttctgaatcaattttggtaatcttaatgtcggcatcgacaacataacctgcatgttttaacgcttcattcaccgagatataagcatcttgtaaggcaacgtatttaccaaccaatgcaatgttaatggtatggttcaaacggttattaacgtgatcgacaagatcttcccacttagacatgtctgcttgtggtgcttgcaaaccaaagtggtccatcacaatgtcgtccatcttttgtgcttttaagttcaatggaatttcgtataaacttgcaacatcttgagattcaattacagcttctggctcaacatcacagaatgcagcaatcttcgaacgcataccatctgtaatatcttcttctgtacgaacaaccagcatattaggttgaattcccaaaccacgaagttctttaacactgtgttgcgttggctttgtcttcatttcccctgcagcttttaggtatggaaccaaagtcgtgtggatgtagaaaacattttctgatccggcttgactcttcatctgacggatagcttccaagaaaggaagtgactcgatgtccccaaccgttccaccaatttcagtgattacgatatcagaatcagtcactttaccagcgcgcataattttttctttaattgcgtccgtaatatgaggaataacttggacagttgcaccaagataatctccatgacgttccttacgtaatacttctgaataaatctttccagttgtaacgttagaatacttgtttaagttgatatcgataaaacgttcatagtggcctaaatctaaatctgtttctgttccatcatcagtaacaaaaacttcaccatgttggtaaggactcatcgttcctggatccacgttaatatatggatcaaatttttgaatcgtaaccttaagtccacgattcttcaaaagacgtccaagggatgcagcaacaatccccttacctaaagatgaaacaaccccacctgtaacaaaaatatatttggtcattaaaattctccttttctaacatttatgactggttaaattaggaaacgcaaaacagttgtttttactgttgaaatactgatacaacaataaaaataccccctattctgagaatagggggtattaccgttcattgtctgaaaaatcctcaaaaggatctccagagcccaaaaaatataatacagagttacagactataagtcaagtttgtatatttagttttcgtcatcttcgtttaattctgatagttgaccttcaattccatctggaagaacatcagtatcgtcatcgttagaaagatcttcaaatgctggagcgtcatctgatgtagtatcttcagcttcgacttcttcatcttctggatcatcagaatcgtagtcaattacatcatcgtcatcagctgcatcggcaagaaaggcattaaccttcttacgttttttacgtacaggacggtcttcgtcttcatcttcagcgtgaattaaggcttcatcaattgattcgaatgggtaccaagtacgaagtccccatgtattttcgcccaaggaaataaaacttccgtcaacgtttaaatcagtataaaattgtgataatcgatttctaaattcctcatctgtcttatctaaataactctgaaccgcgttggctaaatcaacaaaagccattggttcaccactcttagctaaaatagcgtgggcaacttcgatcattgagagttcgtttttgttttgaaccttaaaattttctaattccaactggtgcacgtcctttccacagtctatctcaaataatactacaattaagcagtaaattgcaatcggattttgtagttaccaatcaactgttctcctgcaaaaagttggtaatcaatatttacccttcccgccaggggtccttcttggagttctatctctagaaatggtgttactgtttcaatcggaaaaagtccgtaaggcgtgcgataccgcgcttcaattcttttaccgttagcaaaacgcaaacgcatttcactctcagacgaacgtgttaataggacattgccatccccatcaattttcatggttacgggtgatttttttccagtttcttcatttttttcctgatatcttaagtaaagtgaatcgcccattttaaaaatctgtccgggttcgtcaaaagctaggtgtgttttttcaccttcttgttcaataaatgtctctaaatggatttcaattggaatgccattgtttaatccagccatttgaatcctcctctttgttcactgttctaatgtaataattataattcatttcatatattattctagctttaagcttttacaatctcaccttaaaacttgtataattttagttagatgtttctttttaaaattacaaagtaagaaggtagtaagatgtcccaagaaaatcaacgtttaccgatggagaaagtctttcgtgatcctatccatgactacgtttatgttcaagaccaagtcattttagacttgattaatactaaagaatttcagcgtcttcgtcgaattcatcaattgggaaccacttcctttgtgtttcatggagctgaacatacccgcttttcgcattcattaggatgttatgaagtagcacgtcgcatcgttgaaagctttgctcgaaattatccttcaaaaactcccagtgatggattgtggaataatgatgaacggttagtaacgctttgtgccgccctcttacatgatattggtcatggggcttactcgcatacatttgaacatatttttaataccgaccatgaaaaatttactacccggattattacggaccctcaaaccgaagttaaccaagttttacggcgtattagtcccgactttccaacaaaggtcgcttctgtaattagccatgattatcctaatccacaagtagtacagctaatttctagccaaattgatgccgaccgtatggattatcttttacgtgattcatactacaccggaactaactacggaaactttgatttaacccgcatcttacgtgtgatgcgtccttatgagcatggtatcgcctttcaaatgagtggcattcatgccgtcgaggattttattgtaagtcgttttcaaatgtacgttcaagtttattttcattctgtttcccgttctatggaggtcattcttggacatctcttaaagttagctaaccagctatatcagtctgagcgagctaaccatcgacaacgtaactttcaaccccattacttaatgccattttttgatgaaaattttacgttagatgattatttaaaactagatgatggcgtcttaaatacgtattttcttcaatgggtggatgatgaagatcctattttgagtgatcttgcccatcgcttcttggatcgtgttcctttaaaatcagcacgcatcaccgatcaaactcggagtcttctacctgaattaaaacaattggtggctgaagctggttttgattctgaatattatactgctgaaaatgacagttatgacttaccatatgatgcctatgatccaacctctaaaaaaccacggactcaaattgaactaatgcaatcggatggtagcctagtcgaactttcgaccgttagtgatttagtacgagcaatttcaggtaaagtttctcgtgacgagcgcttctttttccccaaggaaatgcttatagatagtaacgagagtttgtttacagatacttttgaagcttttcaagctcatatcaaaaacaatataattagttaggagtaataatcttgagtataaaattaatcgccatcgaccttgatggcacccttttaaatgacaacaaacaacttacagaagcaaatatcgcggccatcaacgctgcttctaaaatcggggttaacgtcgtcctttgtaccggacgtcccattacaggaattcaacgttacctcacccaactagaccttactaacgaaaaggaatatgccgtcacttataatggagcactcgctcaaactctgactggcgaaaccctcattaaacacacactttcctttgaagactatctcactgctgaagcatttagccgtaaaattggtgtgcatttccacgtagatggtaaaaatcacatttacactgccaataagaatatcagcacttatacggtaggtgaaagttttctagttgaaatgggtcttcgctatcgcgccgttaatgaaatggaccctaacttagaaatgcccaaggtaatgttcattgacgatcctaaagttttaagtaaagcgcgcgaccagatttttgctaagttccaagacaactttagcgtcgttcaaagtgaaccatactttattgaacttatgccccaaaacgttagcaaaggtaacgctgtaactgagttagctacacgtcttaaccttactttagaccaagtcatggccattggtgatcaaggtaatgacctttccatgattaaagctgccggaactggtgtagcaatggaaaatgcaattgatgaagttaaacaaaatgcacaattcattacggccaataataacgaaagtggcgttgccaaagccattcaaaaatttgtactagaaaaatgaaactaggatcgcattaacaattagaatcaaagcatagcttagtattaaacgagtcaatggggtgaaccgcatgggctcgtttttttgtgcagcaatttcttttgcccgctcagttttagactggacagctttatgctcaattttttcaacaaattcactgttttttcgatcgccatttaatttccatccactaaataagtgagcattgaataaaattgctaaaattccccataatagtaaaagcatccctaaaataaaataaatattacttacaatgtaggttcctttaaaaattaatccccctactaccaaaataataaaaataattgctttggtgcttaatttatttaatagattaaatactttcatagtcttacctcttcagtctggtattgcttactactatagcgtctttttttactaattaaaactttattcctcattcgtaactttgaaatcgttctcaatcaatgtataataatgacacaaaggaatgattatatgaataatacgaactacttaagtattgccatcagtgcatcttttattcgttacgcactatttgacgaaagtggcagtcttaaagtaaaaaaacaagttccaacgccaaccgatagcgttgaaaattttctaaaacaaatttatgaaattgttactgaccatcttaaatcgatttatggaatcggacttagtgttcccggccaagtcgacccaaaagatggcgtaatttatcaggggggctcgttgcccatgctccacggactcagccttggaaaaatccttgccactcgctacgaattaccggtgtcgatggaaagtactggtttttgtgttactttagcttctcaatggaatggtaatttaaagggtgtcactaacggagcaaccatcgcccttgatgatggtgtaagttctggcttagttttaaatcaccagattttttctggttcccacttacaagcgggcggaattggcatgattattgccaatccaacggttgaaaatcatcaacctgaagatatcatgttcaacgcctgttctgcctcaaaaatgattaacaccatcggcagtgcgttagagttatctgatcccaatgacgatatcaaagtatttaaggcgattgaaaatggagatgctaacgctcgcgaaatgtttaacgcatattgtcgaaatgtagcttacatgattgtgaatacgcaggccgttcttgaccttaataagtacgtcattagtggacgaattagtaatcagagtattctcgttcctgaaattaatcaccaaattcaaattattcgagaaacgattccggtccttaaagaaatgctggaaatgccggtaattgaaacttcgatttttaaacaggatactgaccttttcggtgcattttataatgctttggatcacttggactttacacagcctacagataacaaagcggaataaaaaggagttacggcttaagccataactcctttttattttgttctataaactatgccaccgcacgttggttaacagtatgagccaagaacgctaagcggataatagctaagttcaaggcttcttctagacctgaactaacctgtaagtatttacttacacatgtatccacctgttggtatagcttagtttcttttaattcttcgtcactagcatcgttgtattgaatatacttttgatcaagttcttcttgttcaattacatcaggaaaatccgtctgtgttcctggtccatcatagtaatcgacaaaattattatttgtattaattcccaaacaaaactctcgcttaggtattctcaacaattcaaaacccagtccggtatgattgtccgtgctaattactacaccctcatcgtcgttaagcggcaagaatacatagtaatcgtgacgattatgatcactcacactataatcaataccgtttaaacctttgatcttagtgatgtagctgttttcgttgattttgattgttttatcttcttcgatcacttttgataaaacatcatatttaaaaatcatttttcttcctccaaaaaataaccataaatactggaacagaagaaattatactccctgcaatcaaaaaagcaacagttgtaatcttactgtaaaattactggaattattttgattcattttggtcgatataaatcgccattgcgaatttcaacaaggttaaattgaccttttgttcatctccatcgctgtaacccagataaacactaatataacgatccgccatttgatattcattactctggataatttcttcatcagtagcattacgatattttttagttaaatcctcgataactggtcctgtaaagagatctagaaaatcagtttgatttccaactccgtcttcaatatcaatgacacccttttctgtattcacttcgaaataaaactcacttaaggggatctcaaaaaccgtaaagccatcaaaggtgttaccatcggaataaaaaacaatgccttttcctgggtttaattctaagaaagcatagtaatctctttcatttctcaattctgagatgaaggtgattgcatcgatttgatcactatccatttttttgatttgactctgatcattaatgataatcggtttcccggtatcaatcacattctttagaatgttataagtaaaaatcatcactctacccccaacgcatttactttctatacctcgattatatcgtgttcacgctcttttagcattttctacggctcagcacgttttctcaattgtcgtacaacttgaacgtatgaataaactaatactaaatttgaacctaaccaagccaatgggttagcggtacatgctccccaaaatccaaaagccggaaccacaaagagtcccactaacatccttgaaatcaattcggctaccccagccatcgttggggccacactctttccgaatccttgtaaggtatatcggatgatgaacaagattgctagcaagaaataactcgcactaacgatcacaaaatattcatgcgccaagttggtgatatgttgttctgagtttccaataaatagattaaccagtacgcgactattcaaaataattaaagctcccacaataaaactgtaagcgaccgaagtgatcaacgtttgacgaatacctttcaaaatacgtttaaattttttggccccgtaattttgagccgtaaaggttgccattgtgatccccagtgacatcattggctgcgttgctagctgatcgactttcccagcagcagtataagcagcaattgctgatgacccaagatggttcaaagaaatttgtaggataattgacccaatcgcgataatggacgcctgaaaccccattggtaatccaatcttgatttgttcacgaaccaatttcatatttgttttaatttcttttacttcaagcgataaaaccggaacgtgagacttaatatagaaccagcatagaaagcatgagattaattgggccgtaaccgtagcaattccggctccagcaactcccatgtgtaaaaagacaatcaaaataatatccaataccacgttgataatacaggcgattaccaaaaatacgagtggcaaacgactatttcccaacgcccgtaacatattggagaaaaggttaaaaaacatagttgcaagcacaccaccaaaaatgatcgtcaaaaaggtcgtggcaccgtcaataatgttagctggggtttgcatcatttctagcaacggtctagccgccagtacactaactaccgtcagcattaaggcgaatacgccacaaatccaaatactcgtagcaaaactttgcttaactgctttaacatccccagccccatagtgctgagccgtaataatcgataaccccgttgtcatcccttgcgcaaatccaataatcaaaaaagtaagtccattggttgccccgacagaagccaatgcttgtacaccgactactcgaccaacaatcaaggtatcagaaagcgtataaatctgttggaaaatatttcccaaaagaagtgggatactgaacaaaataatgcccttgatgggacttcccttagttaaaatactatccatgtaaatcctccgttttttattaaataaaagatataaaattatttaagatgtgaattccaatactacatttaatatcacgggtacgcatataggtaaccgctaaaattgcgcccatgattgcataaataggaaaattaattcctgtatcgtgcaatgcaccaaagataactgcattaacgatcactccgattacttttattactggttgatcagtttggaaaaataattcaaagaaaatccccctaaaaatgagctcttccatgactggagccaccaacacgccatcgatgaatgtccaaattggtagtttttcaaatagtttttcgattgctaattggttagcagaaatattaactttaaattgattggtataccagatttgaaaaagcataaaaatcatccaaactagaaccattagcagcattgtttgagttcgcacccttcttggtggtaaatccccataaatgctatgattttttttaattttatatcgataaaattgccagaaaaagacgataactgctatggcaatcgcaatatagacgattattagaaaaaataaaaagagatgatggttttgtgtatatgctgctactagttgtggaatagaaaccaattgatccattccaaatagtaatactaaaaataggcagttcttcaacacttgtaacgctctcattaagtactcctttttaagataccaactttattttaaagatagcattttatccataaaatacaatcactaaaaactcgtaaacgtgatttttattaagatgcacttaattattggtatattttataattccttaacctttccatggtattctgaaaaagtaaagaaaggtgatgcttgatgattattaacgataaaaaaatggaccagtaccttgaagttcaattaattggccataaagataacaaaatcaaagccaaaaccagcgctggacaatacatatttgtttatcctaccaccgaacaaactaacgatcctttattttggaaaagtttaaaagatattattaataataaaatgtggcttccaattactaaacaatttcatcaattgatagctagtgattggcttgtaccaagtattcaaatttaatccgatattaaaccaagaagctgtgacaaatgctaggatttaatccccttcatttgattcacagcttctttttatttaacaatctctaataaatcagttggtgtttttaaaatatattctgcttcagagaaatcattcgctgggattgctccccatccagcattggcaaaatcgactccagcggcatgcgctgattgcatatcaaatagcgaatcacctacataaatcacatccgctcgatttagcttagggaaatacttctgcataccaaattcaattggatcagcatgaggtttatgctttttcgtatcatctgaaagcacgactttttcaattgctctaatcttaggaaaactacgcatttcatcatcaaaaactcgtctaagcttagaagttacgattccatattcgattcctaattctcttaaaccagcaaacatttcatcaattccatcatattccttaattaaatcaacttcttgattaatccgttcgttaaaaatatcaattgtcttggctggattcgatgaacctaactcgcgtgccatatcaattcctggaagacccattaattcaacaattgcttgcggggtgacttctacgccatcttggtttaaagcatatgttaatgctgccacagatgcatcttcagtttttaaaagggtgttatctaaatcaaataaagcaactttatacttagtcataatatcctccaaaaatcttattagtatttgccacctatattacgcccccttgcccaatataaaaagaagaaaatcctcatttgggactttctccttaaaataaaacatttttgttactaatttgttatataagcatacttgtagttccattgggtacccgctgtgttgtgaataacgccttttactttaggatttttcaagtatgaatatacagtttgataaagtggtgaaacagcttgttctttcatcacaatttgttctgccttaatcatatcttgccagcgtttctcagcattattagcatcttcattttgggcttttttcacaaggctattatattccgtgttgtcccatttgccataattatatgcactatttttttgtaaaatttgaagatgtgaaattggatcattaaagtcagctccccaatgtccaactaaaatatcaaattctccactttgagatctcgaatatgctacttgcgatggcacgttaacaatgtgaatttgtaatccaggtaatgtcttttccaaggactgtgcataaaattcagcataatttttactgttcccctcattatctgaagttaaattaagtttcaaattctttactccaatttcttgaagccctttttcccagtactgcttggcctgtttttgattgtactcgatggtaccgtctaaatatgcgtcatcagcaaagtcctttcccgtttttggattattagctaaatccgtgggaacgaggcccttacttggtgttgaagcatccccaatgattttttcaatcaactgcttccgattgattgaataggcgatagccttacgaatatttacattattaaaggctttacgtttggttttatctgcatcattaaaattatattgtaagaaagtggtaatggaatatggaaaggtggtgtaatctttattatttttatagtttttaacttgttcactggaaagctgtgtataatctagcttcccggattggtataaattcaacttagtttgtgggttttccaccactctaaatttaatttgatccaatttaacaacttttttatcccaatattgtggatttttaacgaaactccaagtatcgttcgttcctgtccagccttttactttaaaaggccctgaataaaccgtatattgcgcctttgttccatatttatcgccatatttttcaacagccttttggctaattggtgaaaatagtggataactcattaaaactttaaaatattgaataggttgatccaaatgtacaacgaaagtttgatcatctttagcctcgacccctagcttagagggatccatcttacctgcattaatttggtcggcatttttaatcccttcaaataagtaagcatacaaagctttagtcttaggattaatcgttctttgccatgaatagacaaagtcatgagctgtaattttactaccatcactaaatttagcatttttgcgaatcttgaaagtccacgtcaatccatctttagaaactttagcctcgctggccaaacctggggttgtcttaccatttttccctaggcgatatagactttcaaatacatttccagtttgtccataaccattggctttagatacatccagcgtgtccaagggagcatcagctgctaaattcatggtttgttcagcagcatagccaccttttttagctccacaacccgccaataccaccaatgatactaaaataaccgaaagaaacccgatccactttttatttttcattttctactcctttaattttaatcacatcaacttggaaacaccctacaatcgctacattcagattccatatcatcacgtccttaacaaacaaaaaaccggctaactacaccgcagtgtaattaaccggttcaactaatcccaattggttcgttgaataattccgctatttacgcctgccaaataacatgtggtcttttagacaacatgcgcaagcttcaactactgatttagtattcgtaaatagcatagaattactccttgttttattttcaattattagaataccctattcacttattttttgtcaattcaaatggcttaacttctaaatagttgtataattacatgtaaacgtttcaactatgaaactacggtaaatttaattattgtgctatcatagctgtaattaataaatgaggtggacaacacgatgaaaatagcattaataggggctggtccacgtaatttaatggcctttgaacgtctagtttattgggcattagatcgcaaatgggcagatgaagttaaaatactcatatttgacccatttggaataggtggacgagtttggaaccctaaccaaaatcatgaactaaaaatgaactctctggcttccaaaataactttatttacggatgattcaattcaaatggaaggcaatcctcatttaggtccaactctttttgaatgggcaacaactcttggaaaagattttattgaaaataataattttaagcgccaaaaacttttattagaagagattgatcatttaactaaatactcttatagctctcgggctctatttggtatttatcaacaatggttctttcaacatgttgaaaaacgcatgcctagtaattttagtatcgaaattcactcaaatttgatccataacgtcaaatttgacaatgaaaagtacatcttgcttacagatgagttagcataccaagtagatgctatttcagccgctctgggcgaagggatggatgaaccaagtgacgcagaaaaagaggctcaagcatttgctgaagcacatcatttaaaatacgttcccgttcgctatcccgccgaagttgatgttgatgacattgcgcctactgatcaggttatcattcgcggcctaggcttaagctttattgattacctgtccgaactaaccgaacgtcgtggtggtgtttttcagcgtgatgaacggggttcgttaatttatacacgttctggcgatgaaccaacgatctacgctagctctcgtcgaggacttccttaccatgctcgtggtttagaccagaaaaaagttggagagacttatccacgttattttctatcagacgcgtatgttaataacttggtgcttaaaaatcaatcaattacaggatcagaatttattaagcgtattacgttagacgtcgaattaacttactacgttactttagctaagttactataccctgatattaactccgttgaatttgaaaaagaattggctacggcttctaatggattcaaaaaaattctagataaatacaatattagcgctaaagatcgcgtggattggtcagcttgggagaatccaattcctaccagtgttactgacactgcttcctttaccacttttataaaaacttatctccaacaagatattgatattgctaatgaaggtaacaaagtttctcctttcacgagcgctgttgaaaaattacgcgaattacgttccaacattcgtaaaatcgtcacctacgaattactaagtgacgatgattacgtgaaatatattttaaagtactttaacgcattaaatagctttttagcggtgggaccgcctgcgttcagaattgagcaaattttagccctaattaaggcaggtgtgctcactttaaccggtccaggtatggtcgttgaaaatgaagatgaccattttgtaacttattcatccgtattgagtgatcatcaacgttattctgggaatgttttaatcgaaggacggttaccacagcctagtgctgaaacaactcaaaatcctttaattaaaaatttgcttgctaataaaatggctcgcatttactctttgtatttgagcgacggaactttatttaagaccggtgctttagatgtcactaccgaaacggctgaactagttactcccaacggtaaaatcatgcctaatttctttttgtgggggcttcctactgaaaaacggcattggctgactaatggtgccccaattcctggtgtaaatgatgttcgcttacgtatggctgatatgattgccgctaggattgtaaaatctgctaaataactcatttaaaaagtataaaaaacaagcgataataaaaagtttggttgaatctaaaattcagaccaccttttgttatcgcttgtttttatttcaaaaattaatattgtccaccatgtacttcagcaacgttggtagttaaaataaatgcctggggatcgatttcacgaatccgaccgattatacggtgatattctgagttttctactacaagcatcaacatgcgcttgttatcccccgaaaagccaccttgtacatctaagctagtatagctttgatcgagagactccgagataatttcttcaacctcggctaagtgactactcataatatagacactttttttacgatcgatacctgtctcaatatagttcattactaataaagtaattaccgatgagaataaagctaaaataaatgcttcaattccggaactaaagatattcatcacacaaaccattgtatcaattaccaacaagctgacagatggcttaaaattgaagtatttcttcaaaattagtggaggtaccgttgtcccaccactagatgcatcgatttgatataagagcgctactccaagtgcgtataaagcaccaccaacaataactgctaaggttcgatctgacactaaactaatactaggagtaatcgccatacagatcggtaatagtaaactacccactgtaattcttgcagtagtttcttttcccaaagtaaagtacgacgcaagtaacatggcaatgttaataacaaatacaattaaagcacgattccaacctagggcatcttctaaaagaattgagataccggtggctccaccagccgcaacattgtgaggagcgtagaacatattgatacttattgctagcacctctagtgcaaccaacattaccgcaaattgcataattaacttaaatcctttttctttcatacattcctccgtttcactgacttccttctaaaaaaaggaggtaagccaaattaagacttaacctccttttattataactaaaatttaaccgttattcttgatatacgaatttaaatcatctggagctaaattttgccacgacttggcataaaactgattgttcattttgtatgatgggatttcttgttcgccatcaacgaaagccttaacctttttatcgaaagcgtaccaaccattccaacccaaatgaattgtatcttgcataaagtagggttgtgaaccttgattagataaatcagcaatgtggtcaaatccttgactctttaattgatacttaatcttcttattgaaacctttcagcatcgattgtgatagaccagcataatttgcccacttttgattaattggtggtattacaaataatacatcagttttatcagcagcaaattgatttaaaaccaattggaaatctgcgaactctggggacttagtgtagtcataatttctttcaaatcctttaaacttacccaatttatctttcagtcgatgactgtagaaggaatttttgattccaaaatcattatttgatgtttgttgcttggcctgtttaataatcgcttggcgaattaaatctcccgattcactatttggtagagcttgcagctggcgattaattttcttttgattatcatctttcagtttcaaactagagaaaagttgatcttcgtgagctaacaaacgtttgtaataactaatatttcgttgagtacttgctgataatttttgcccttgtgctacttgacgaagagctttgttaatcattccatttccattatcagtgttttgttccatctttaataagcgatgggcagcgtaccgatcagttcttgtaccatgctgcttttgtaaaaagttaacagcttgcagttgtgagaaataaaatgaaaatgcttgaggattagccccttttttgacaaaccattgaggagaaatcacaaatacggccttcccatttttaagctggtgattgattccttgcatctggaaataatgggttaaagattgcgtcccagctgctcccattaagaatggacggaaatcccaattatacttttctgccataactgagggatgcgtcaaatcaaagcgtgaaaattctgacgatccgaaaaatggtacataatatggatctgataaggcggctcgcttaactgcatcgccctttaaaatatttggtgacaatgatgtcgcggcttgcttctcaattgttggactgattcggtttattttgaatggggaaaataaaagcccaatcaaaacaactgatgcgactagcaatggaccaaatatcatccaaagttttttacccacgattactgcattgcctctactttagcgataattttatttggtgtatcccattcactgcgctcaaattctgaaactggggccataattcccaattctgtttggagttggagtaatagttgcaccgtacccattgaatctaacaagcctgtttcaaaaaggttttcatccatactattacttacatctgaacctgtaagatctgccaaaatgtttaaaactgtttcttttgtattcataattaattattctcctttatttttagtggaaccataatgtgtctaaaaatcctgaaaatacgaggaacgtgaaacaaacaaagttaaacgtaataaaaatcgccaagtattcagtaaatttattatgtgggaatcgatccggattctttttcttcaagtttagccaccagtcattaataactaaggctaccccatgaattagaccgtaaacaatgtaataccatttctcaccgtgccaaaaacccattaataacatgtttaagacataggtgatattggcagttgttttaggattcttaaatattttatgcttcatgaaaaagaatactaatcgcatatatacataatctctaaaccaaaatgaaagtgtcatatgccatctattccaaaattctttaatatttttagatttaaatggttgattgaagttcattggtgtttcaattcccatgaaataactagttgctacagcgaacaaactgtaaccagcaaaatcaaagaaaagatagaaactatatacgtacattactcctaccagcccccacgacagaccagtcgattgcacagctaaatgctgtacctttggaagtaaaattgtcccaaagagatatgccaacataaatttatagacaaaccctaagaatacgtaatgtaaggctttttccaacatatttaaatacttttcgcggtccggaacgctctcataatcttttctaaaacgacgataacgatcaataggaccggatgaaattgatgggaagaaggccataaattgtaaaaagaaccacggattgtaatcctttaacactccatcgcgaatttccataacggtttgtacagctttaaaggtcaggtaactaatccccaagaatccaataattgatggagtccccgacatcagtggcgttaatttcacgaccactagtggtgatatcgcaagaagaaccgcaataacgaacacccacgtgtcgtttttctttttacgatatacgttataaagtgaaactaaaatcacttcaaaaattaaaaatccaactagtgcaacgccttgctcccacttaggtcctccaaaggataagagaatgaatccgattgatactaatagttcgtaccaacgaaatctcttgccccaaaggattcctacaacaatgggaataaatgccacagctagcatgccaaaatacattggattttcatatggtgttaatgaaagcattaggcattaacctcagcaataacagatttaatatcgatttttccgttggccgtttgcggtaaactttcaacaaatacaaagcgatttggaacagcatattccatcatgttatccttcaaactatctttaatcgcaactgttaattgaatttgagaatcgaactcatttttttcaggaacaacataggccactaattgagccaccttttggtctttcccatatttaggaactgccactccagcctgaattaatggatcgttatttaagtaatggttaacctcttcaagttcgattcggtaaccatgcagtttaatttggaaatcagtccgtccatgataataaagcattccagtatcatcaatcttaactaaatcaccggttttataggcacgttgaccttcatattcaaaaaaggcttcgtccgttttttccggattattgagataacctttggaaacacttggtcctgatagaactaattctccttcagcaccagcattggccattcttccattatcatcaaggataaatcccagagtatcttcttttaaatatccaattggtagacgatcatattgtttaagtacctcatctgtaatttcgattgcactaactgcgacggtcgcttctgtaggcccgtacgtattaaagatttttgcatctggaaaacgtagtttaagagcctgcgcagtagcgtgtgttaattcttcaccacagaacaagaatcggctcaatgctggtagatgttctgcatcaaaagtcggttgcaacaaacagatatccatgaaggatggtgttgaaacccacacatttaagcccaaagtgggtaatatttcaaataattttttgaaatcatccgtaacttgcttgggcaccgctttgattgttccacccataactaatgtgggatataaatccattacggataggtcaaatgagtaaggtggctgtgataacgtcactggacgttcaggtaaacctagattgccaatttcccaattcacaaaacttaaaagattattgtgactgatttgtactcccttaggcttaccagttgtcccagacgtgaaaataatataataattatcatctttagtgacgaaactattaggtgttacatttttatttgcattaaaagcatcgtttaattcttgtccttctagaactggtagatcacccaaatttacaggcaaatcttcaaccgcgatacacatcccaggattagcaatttcattaatcattgttaatcgttctgctggtgagtggcgatcaattgggacataagcgtgtccactttttacaacccctaaaaaagttgcaatcatatcaaaggtttgagcaccataaaccataattggcgcatcttcttccaacccttgcgttaaaatatatgaagctaagctatctgaataagcttttaattctccatatgtgttcttagtacctagataatcataagcaatccaatctggatgtttaactgcgattgaatcaatttgctcaatcacgttaattactttccccataattaattaaatcccccgtttaaaattcgttatagataaatgttccgccagtcattccgctgtaatcgtacaagtacaacaagacgactaaaactgcaaagtaaaaaacagttcgcgtaataaattttactgaatcatgttgccataaatctttaaaaaaattcagcatcacaatcccccctgctaattttcactaatttgatagtgaatttataaaaatctaattgcgttacgtaaaagtatgccatttttttcgctctttgtaaaattcctgtaatatagcgggctaaaaaaattcatatttatcacataaagttcatatggtttttaagaagtgttcccatcaatacagcattttcgacacttattttaaaaaagtttaaaaaaagctaaaaattagaaatatcgctgtctccagcggtactaaataatttctagctttcatgtgttatttaagtttgtatgcaatcgttgctaccaagattgctttaagtatatctcctgggattaaaaggctattgagtgctacagctctgattagtggaatgtgcatattaacagcaaagcccatgctaccaaacaaatcgataattaagacagctacaatcgcaatttttgcaaatagcaagaaccattcatggcgatgcttcttcgaccaccaagctaataaaacggccccaatccaatatcctaggagatatcctccagtaggtccgataaaaacggccatcccaccccgaagtccagtcaaaatgggtagtcctattaacgccaacaataaaaatactcccgttgttaaaaatgcttcaaacggcgataacaataacccaattaatagaattccaatgttttgaactgtcaacggtactggaattataccaatcggaatcgctggaattagtcccaaaacaatgactatagctaatagcaatgccatacgtgttaatctttgaacttcgatgtgcattaaatttcgccccactaaactaatgaggttatattataccattttaatttgaagctcttctgataatcggaattaatctaaaatataccaatccaattgcaattccaacgataatcccttttaacaaattaaaaggcactacaccataaagaaccatatttaaggtcgaaacattaatttggaaacttgctaacttcatatataagggcaatagaatgaataaatttatcacactcataaataccgtcatcaaaaccgaaccgattaagacccccttaatcaaggcccccacttcttttttatgcgtgctaccttgaaccgctttaattgcgtagtaaatcggtaagatatatgacaaagctgccaaccagttagcaaatgcgcccaatgcacctgctggattactatctcgaaggattatatccatcagtccggctaaaccagctgtcaccatcccccagactggcccaaataataccgtcccaattaaaactgggacatccgcgaaatcaatctttaggaacgaaaatccgggtaaaattggaaaatcaatgaaaatcaaaacaaacgagatagctgctagcatagcgactacaaccatcttattaactttagaaacactcatcatactgcctccttggatttaggagcaccttcttggtttatttacacaaaaaacaccaatgcaactggggcattggtgtttagactgttttattattacgttagtctgcgcaaataaattcaatcttcctttatctagactttaactatcggtttcggaatttcaccgaatcagccatcacgaatgacagctcatggactttaccaccggtcgggaatcgcaccctgccccttgaagatgaaccgttatttttttgtaagtatttcattaataaatatatagtacaaatagcttattcgtcaatcatttgtactttctttttttacttgaaaaaaactttccccatcttctagcacttcgataaacaaacgttgatcttttggtaaacccttaatttcacctaagtcaaattcatagccattaggaatctcacgaccaccactaaaacgttctttaagaaagtgacgtaacgctttcataatgcgtccgttactttgcgctttttcagctgctttggctaaagtgaaaccatcttcaatatagctagcaatattaccagcttgaatcatcgtaaaataggtatattttcgttgacctgtttttgaaattttagacttaatataaccttttttctcccaataacgtaattgtctagttgatacatcgacagcattggccacatcaccgatactaagtaacatagcttcgctatcaattattttctttaccactgctaggcgacccgcggggttttccatgtttgctcctcctcattaatgctgtatatcttgttgcatcttttaaactaattataacttctctaacatctttgtcaaacaagttgacaaagatgttatgataacttatagtattaaagaaaagtttttgaaaagaggttgtaagcttatgccacaagcaattgacgcacatggtaaaccctataagagatccttattgatccttgtgctattaataggtactttttgtaccgttttgaaccaaacaattttaaccaccgcatttcctacattaatggatgcttttgatatcagtacttctactgttcaatggttgacaactggatttctgatggttaacggtatcatgattcccattagtgcctggttaacaagtcgtgttccttctaaacgactttatttatctgctatggctgttttcctaattggaaccattctatgttacacagctcctacgttccaagttttacttgccggacgtttaatccaggctctcggagttggtgttaccatgccactcctccaaactctaatgttgacaattttcccagctaaccaacgtggttcagccatgggtcttgccggattagttattggggtagctccagcaattggtcctactctttctggatggattattgataactatcactggagaaccctattcggaatgattattccaatcgtatttatcgttctaatcgctggtctattatttatgaaagacgttttggaaaccgacaagaagaagctagattggatttcagctgctttatctacaattggatttggtagtttactctttggtttctccgaagttggagacaaaggctggggcgacgcagtagttattactacattaatcgttggtgttatctttgttattttatttggtatccgccaattgagattagaaaaaccattccttgatttacgtgtactaaagattccagaattttcaatttctgctactttaagttcagtttcaatgattgccatggtgggggctgaaatggtacttccactttacattcaaactgtacgtggcgaatcagctttccattcaggtttaacactattacctggtgctttaatgatgggattcctaagtcctattactggtcgcctatttgataaaattggtgcccgtcgtctagcaatcactggaatgttcctcttaactgccggaacgcttccatttgctttcattaccaagactacaccaatgatttatatcattgtcttgtatgctgttcgaatggccggaattgcgatggcaatgatgcctgtaacaactgctggtatgaactctcttccatttgaaaagatgggtcatggtactgcggttaataacactcttcgtcaagtagccagttctgttggaacagccatcttggttagtgtcttgaccaacgttaccaagaaccaaatgcctggtaagcatcttctctcagcccaaccactcgcttacaaagatcaagcatttgacgcaaccgttgctggttaccatgcgacattctggattgccattggctttagtgcccttggtttaatcatcgcattctttgtaagtcgtaaagcaggtagcactgccaaagtacaacctcaagcaggaggtaataaataatgattatctttcttttaattatcgcagtcatcgcaacgttcctttcgatgacacttatctctaaaacagctgtccgtgttatttgttctgttatttctgcaatcgtcgtaattgcttcggttgctttgatggtaatgaatgatcgtgaacattttgggatgcataaaattactgaaacaactacccaagaaatctactcagtctcaccttctaaacaaatgagcatgttactctataagagtatcggtaccgctgataaagatcgagtttatatctacaataagactacttctcaaaagaaacctagtcatactgaaactgataaaactactaacaaggttaaaacaactaaaaagagtacggctcgtttagttaaatctacaacccgttggacttataagaacaacacttacaagttctggtttggaattgccggtaataaccgtgaagtttcaaaacgtgttaatactttctacgttcctaataattggattaccttatcaacagaacaagccgctaagcttcaaaagaacgttaaaaagaatcaagctcaaatgaaagctgatgctgaaaagtatgttaaagctaaggtcacagctactgtgaagtcaacaatggctgccgcacttaagaagaatcctacaatgagtgctagtgatcaaaagaaactaatggctgatacaacggctaaagcttctaaacaatatgctgctcaatatcaagctcaaatgatgcagaagatgattgaagaagctaagaaataattacaactaataaaaacacgctgaacttttgaagttcaacgtgttttttgttttactttgaaataaatttactaatttcttcaacaatctcctttgatgcatttcccgcattaatcttgcagaagcgatcataaaaagtattaaatcgttggtcgatgctcatattagactgagctagtccgcattcaattttatcccaaagctcgattggattgtaggcgatttcccccggtagatctttttgatagtctaaataaaaaccgcgtaattcatctttataaatttcataatcataaggatagaacaaaattggccgcttaagataagcataatcgaaaaagacactcgaataatccgttattaataaatccgatactaagtataattcagaaatatctgcataactagatacatcgtatgcaaaattttcaaatcctgaaatatccattgaattcgctattaaataatgcattctaagtaaaagcactgcatcttttccaaatcgttcttggaattcttttaaactaaaaggtaattcaaatgaatatttacccttttgaaaaaattgattatctcgatatgttggagcatacataataacctttttatttaaaggaattcctaatttttgttttaataatttaatttcttcttttgtgggattagccaatttatcattccgtgggtaaccgatttctacaattttgttctgataaccaaaagctcgtcgaaaaatattagtcgagtatgtatttggactaattaatacatcccaacgattggcttccctaacaaaattttgatgataacgttccgtgttcgtcccaggcatcacaacatttttaatatctaatccgagttttttcaaaggtgtcccgtgccacgtttgaattaattttatgtgatcgggtttctgcacccactgcggtaaacgagcattttcaacccaaacttgggctttttcgattgttcgaacccatttgaaagagccacgtattacataatcatatccgttcttctctgcctgggttgctaatcccttatttacaacccaaatcaaacaatattcaggatgagtttttttcaactctttataaatagctaacggagaatcgctgatttgacgtccaccaaagctttcaaagatgatggtaggctgtgagtaaggtttgtaatttatgttaaataaataaactaaaaatcggcgttttacttttctcaaaaaattaattaagtacataatactccatctttctcaatcttagttgttcaatttagtatattatatttttatgatttcagttagcataaaacttgaataatttattaacaaaaaaacatggaactattttccatgctttttctaattacttataacctaaaaatttcttcgataactggtcaacttttttctttagaccattgttaccactcacttgatggttactaaatacaacaacagctttctttccatcttggctaatacgaacatgactttcaaagccatatccataaccattagcatatctataaaatggtttcttagatgtatatagaccagcgcgatatttaccattacctagtggtaaataaagttctttagctgcgtctgttcctaaaattttcccatttaatagactagctactaatttataataatctggtgcagacatatatacttgaccagttcctagctctgaaaagacagtcgcaccattgggattctgcttaattctatccccatttccttttactacatatccataggcccgatttgtttttatattattgtcataagcaaattcagtttgtttaagctttaatttttttatgtaagtttcatcaaacaactgtttatagctctttcccgtaatttcttcaagaatttctgataaaatcacaaaattgactggttggtaactccacttcccgcttttttttgtattagcatcaaacctaacattatcaattacaacatctagcaattcggcactagataaattgttccccgaaaatttcatttttttcattgataatcccgaattcatatcaagtagttctcgaattgttatatatttagaacctggtagatccggaataaacttattgaccctatcagttaattttagctttcctttattgacttggttcattactaaacctgctgttaaaactttttgtagagagtctatttcataagtagtcgttaacatatttttatcaacatcagtggcagatcctgatacgtaactatctactattttgttgttcttaattaagaccgctgtaccgctaaacttagtcttcgagagacttttttttaattttccagactcttttctatctacaattcttgttatggctgtttttgttttagtattagaaacaactgtatctcccttttttaaagtaacgatataacatgctatacatataaacattaaaataccaataaaggtataaatccattttttcattggtttgctccccttacagatagatactaaaaatactctaaaatttaaattggcgtcctaaatcttagagtatttttaaattatctttttctactcattactaatttaaatgccgttatgctaaaccatagtagaccagttaaaatcatgatccatccattaataaagcttgatttatagctaactgttaatacatttttcccagattgggttgcttttatagttggcatattcatcgtgcctaatgtgatattcccttttaataattttgaaccattcattagcaatatcgtatttttataaacggtaattggtatttttttactttctcctttatgatttgcataccacgagactattaattttccatttttaacttccttttttacaccttgttttgagttaataaacaatgctgcatatgtttcataggcactctgtgatttgccattatcagtattattaacattaattggtacatagtccgtcgtcggtttttcggccagctcaatacctttacttaagtcgttactcctaaaagcatttcttatttcactttctgaagcattatttttaactattacattagtcctatttgctatcggctgatgaccattccagccttcactttttgactgtacgttatagtaagattgtactacggaaaaaagtgttgctatcattaaaaaaagcttagtatactttttaaaagaaggttcattaacctcctcaatacataaacctaaacctaccagcaacaatacaaatgcgaaaccttcaagtcgactaggaaattgtaaaaaactatttaacataggtatctttctacctataaccatccaaggcataatattagatgaaagtactaacatcactgtccctataccagttacagctttagtagttagagataagatcgaccagttcataatagtaatcgctatttcaaaagcaaataatacacttacaataattccaatatggttaaaatcagcattgcctaccgataaattcatagttttcattgctaaatttgcagcaaaaggaggatacaatttattcccaatatatatttcaaggattgatccccacacattaaatgtaagcaataaagttagtccagcagccgcaatcacttttacacatagtgtaagtttatctttcacatttataattccaattataaagaatagaaacaatataaagaccgatataactgcacttaacatatgtatctgaatcatcaatgaaacggagatagataattcaacaatcgtaaatttatcactcttaataaatttaatacccacagcgacgattagtggagctacagcaatcccccacggcataaacatctggctaactgtccaacccattacccaaaaactactcatgaaaagcatagaattcatattggctacttttctagatagtccaacactagtagataaatagttcattgtatagccgctgatcagaaataataataatgatgatattacttgaaattttaaccaactcctacaaatgaataaaataaaacctaatatatatgccagtcctggaccatataccgcattcacaattctagcggtttgttgaaaaccataattagatgtaaaataactaaaattaccactatcaaattgcattgcgatatcgtacaacctattaaagtgaaaaatagcatctgcccctaatataatacttttattcaaaatttgaggcatcgttagtaataatccagtaattaaaataactaaaaaagtcccaacgttaggattcttcatagttctttctttaaatttcattttttaaacccttccaaatttacgatatgaaaattacctaactttatgttgtactggatgcattaacgttgttggatgttccagcgaattagtaactgagtggccagaaatgtttaccaacgcaaagaatgcaagtcctaatattgctattccagtaacaatcctagttgtcaaagacatcttgtctggagttatttgatgatacattctttcctgtacatccttttctgcttgatttttatcgatgcccttcttgacttcatcttcaattagagacttacgatactcatctatgttaaatttaatttgctcttttttcttatcttgttggtattttttacgttctttggccgtcttctttttgaagtcacttgagaatttacggtagtgttcaattacttcctctgtctcgccaatttctcgtagttctccaaaatgcatccatgcaactctatcacaaatcatttttacttgattaagggaatgactaacaaacaaaatagtctttccttgttccttgaattccataatcttgtccacacacttttgatagaaagtatcatcaccaacagacaatgcctcatcaataatcatgatatcagggttaatgtgtaccgcaattgcaaatcctaaacgggaacgcatcccactagaatagtccttaactggttgatcaataaaagtaccgatatcggcaaaatcgatgatggaatctctaacttcatcaatttctttgattgtcaaaccttgcatcagaccctttagacggatgttttcggcaccagttaagtttctctttaaaccagcgccaatagcaataattgaagtatcacctttaacatcgaccattcctgtggtttgaggaatgattccggaaataatatttgaaatggttgattttcctgaaccattcactccaattattccaaaagtttccccttttttaattgttagactaacaccttttaaagaccagaaatgtggaacatctactttcccaatattaaaaaagttctttagtttatcactttttgatttaaaaaggtcatactcttttgttacattttctaatttaattttataagtattatccatttcagactcctcggcttaaatcaaatccacaaaattagcacggaatttattatgtagataactaccaaatatcatcacaataaaaataaacaaccagaacgaaatcgttaagttgagatttggttgttgccatacccagcccttagaaagcaacgactcccggattccgttaataacgtaataaaaaggattcaattctaaaagacgtactaatacaggtggaaaatttgaagtaacgaagttaaacaatactccactcatataaaacagcattcttaacactgattgtagggcaatttgccaatcacgcactagtacacttactgttgaattaaaaattcccaacgcatacataagtgcaatcatacaaataaaataatatatgaattggacccatgaaatggttggccaaattcgattaacaaacatcaaaaacacaccaaaagccatcatcgtccagaaactatataaatttcccataattttaatagatggcaaaacgttaattggaaatttcattttagaaactagcccaacttgttgataaatacttttagaagcatctaaagttgtcttattcatatacaaccaaggagcaattcccatcaccatccatggcaaatatggtactcctggcattggatctccacgcttcaaagccaccccgaagacgagatagtaaattccaatttgaatcagcggattcaaaaattcccaagctaaacctagataatgactttgataattagcacggtcatcatacttagccatccgtcgaattatcttaaaattagtgaattggtcactaattattttgaacattgtattcatcgtttgtattgctcctttaataaatataactaatttaaaactttactataatttcaaaagtaattaaacagtattactaaacttttaaaaatcttattttctaaaattatgtaaaaaccaataacgtatattataatacattattagacacataaatattaaacaacttaggtaaaggtgaacattttgaaaaacgtagaaaaagcaaaccggcaagataacttaataagtgtaattgtcgcttgctataatgtatctgaatatttaagagaatgcctagattctctagcagaacagacatttcaaaaaatcgaagtaataatgattgatgattgctctgacgatactactccttcaattatcgatgagtatgctcaaaatcatcctaattttattgctgttcataatcctgaaaacgcaggtcctagtgcctctagaaacaagggcattgatttagcttctggaaattggattgcctttgtagatggagatgatatcgtcccatccaatgcatattctacgatgatgctttcagctatgaattcaggctccgaaattgtgacgggttttgtgcgccggtttgataagagtcgtgataaaccttcctatctccacaaaaaagcaattattgatgattataaacacacaagtctaaaagaacatccagaacttttatatgacactacaagttggaacaagttgtataaattagaagttctcaagagagaaaatattaaatttcccattaatcaaatttatgaagatgtttccttcacttcaaaggcatttttagcgagttccggtatagatatcctcaccaatgttgtatacagatggagatggcgtgatggtggtaattcatcttttactcaagtaaaaaatgaattacctagatacctcgaccgcttaaaaagtttatatcaagtaaaaaacatcttagaacaatattcgctttggcacggttctagtaagcgccaattgttatttaaactattagacgtagatattccattattcatggacgatattgccgatgcagatgatacttttatttatgcgtttcaagaggccactatcaaattttttagagagtgggatttgttagatacaccactcatcaaactgttgtctgctaaaaagcagtatcaatactttgcattaaaaaccggtaattttaaccttttaaaacaattatcttttggccatccattgaatggtaaagtggcaaatcttgatagaaagaatcgaaacattcctatttttcatacacctgcatcattaaaggttcggataacaaaggtaaaatatttgaacgaacagcttaattttgctggaagtttacaaataggaaaaaaatctcctcatcattttccttttaagcaagaaatcgtcaatgtatatctggaaaatattgctacgggtaaaaaagttaaaatcaatacatttacgcgtccttttaccatttttaatttccatttaaaacgcatgacgcctcctgcaagtaaatttagtttttcagtgaacccagttaaatacgttgaaaagcttgggcttggaacttacaaaattaagattgattataaaaaaagtaaaagctctaagttactttcagtctatttaggacagcctaaaaaggggtctggatcagtttcaacttttactgacccaacaggtgatatttcgtttatctacggacataataccaattgggaaaccactattaaggtagttccgacttccgatttagcaattggaagtactaaacttccaacaacagtaacagacgttaaattagccagttctggtagtctaattatcagcggatcttcctcagaattaaatttaactgctaaaattcaagatactctattaccttgttcttttgataataacggtaatttcaagttagaaattgaatcaacttttttaaaaaattactttaatcagagttgtaaagttaattttataaacactcagactggactaacgattttgcctagttttaaaattactgaacaattactaaacaactctactttaagtgttgcactttcaattaatccagctaagggattatggattagacctgatgtttcgatagctccagctaataatgtacaatttactaagaattctaatgctgtttcccttcaatttgaggtaatcccctcaatatctactgaaaaattgaacgctacgggaaaaatcgaactactatcatctgacctaatcaatcgctatctaaatggtggtacagctactgttttaggcaataaaatcgttggcacaattcccttgggaaacccaacacaattaaacgttctttctggaaaatatcatatttatctaaatcttttagattctaaaaatatttcttacagatttaaattagctaatattaatcctgtacaaataactgttcaaaatcattcgattaataaaagaactaattctaccgttcttttagacaaattcggttttttgaagcttaatattaatcagaccaaaagttggattgatcggacaaaaattcgtagagggttaacttattccgttctgtatcctttaatgcgattgttacccttaaaaaaagacactgttttatttgaaagtctttggggtcaatcatataacgacagtccaagagctatgtataaatatttatccaaacaacgtcctaatatggaattcgtttggatcctaaaaaatgaacaaactccagttgagggaccagcaattcgagttcgtcagatgtcctttaaatactggtattatatggccagagctaagtatcttgttcaaaatactaactttccaaatcagtattctaagcgagctggtcaaattgaggttgaaactctgcatggaacatttatgaaggtaatgggctttgacgaacctcattttaaaaatgcatcgaatcgtgttcagaaaaatttcgctaagcgaatcggtcgttgggatttaatgtccgtgccttctgacttcatgctgaaacatggatctgccgcattcgattatcctgaaaagaaaatactgaaaacgggctttcctcgcacagatgagttgattaccaataataatactgactatttagcctctattaaaaagaaactaaatttaccggacaacaaaaaagttattttgtatgctcctacgtataggacaacaaaagatgcttttaattttgagttggatttagatatgatgcaaaaagaactcagtgatgaatacgtcctgcttgtacgtcttcattactttgtatctcattcacaaaatttcttgaataattctggatttgtttatgatgtcagtgactataacaatattaatgatttatatctgattagtgatgttttgattactgactattcaagtgtaatgtttgatttcggttacttaagaaaaccaatgattttcttcgcatatgataaagattggtacttggatccttctaaccgtggtatttatatggattatgatgctacggttcccggaccggttgcactaactaccgctgatgtagttaattcgctcaaacacattgatgatgtaaaagtaaaatattctgataaacttcaacaattttatgataaattttgtgaatatgggcgcgatggagatgcagctcaacgtttaagtgaagctatgcttagcttaaaacctgaaaaccaatcatcagtagaaaataatctaatacgctcaaaaatccaacgtttgttaaaactaaataacatacaacacaaattattaaatattcttggacaacttctaccaaaggcaaatattgcaatgtttgaaagcttctttggacgtcaatattctgacaatccaaaagctatttatgaatacatgaaacaaaattatccagaaattaaactttattggaatgtcaataaagactacgaggaatactttaaaaagcataacatcccctatgtaataaggtttagcctaagaagtatttggattcaagcacgcgctaaatattggtttactaatgttcgtcgtccttttagatggtttaaacctaaagatacagtagtagttcaaacctggcatgggacacccttaaaaacaattggaactgacgttcagcaggtcactatgcctggagtaactcggatgaaataccataaacaagtaatacgggattcagcgcgttgggattacctattaacgccaaacccatattcatacgaaatcatgcaacgcgcctttagaaagcaatatccacagctactcccaactggatatcctcgtaatgatcgtttaagtaatgcaactaaagatgatatcaatctattaaaagatggcttaaatattgctcataatcaaaaggttgtcctctatgcaccaacttggcgtgacaatgactttgtacgagcagatcactatcgcgctgaattgcaccttgatttagataaattaattgcagatctacctgaaaacacctcaattttagttagaacgcattatctaattgctaataatcttgatttaaccaaatatggtaatcgagttattaatgttagtgattatgaagatattaccgacctatatttaataagtgatgttttgattaccgattattccagtgtattttttgattattcgattcttagacgtcctatgatcttctttgcatacgatttaaaagcatatgctgaagatattcgtggtttttatatggattacaattcaacggttcctggtccagtcgttgaaactaatgaagagttaattccattggttcaacaggctttaaccgagcctactaaattcattgacaacgatcagtatcgagctttcttagaaaaatttgcttcatgggaagatggccattcaacagaacgattactagaaacggttctcgaaaataaacctccttatgaacttcagcaattaactaatagtgatagtctagttgttggcgatcaaatacaaattaaagataccacgattctatggtcaggaattcctggagtgaaaggaactaaatttattaagaatattgatctctctgaacgagaagaaccagtattcataaaacaaatagccactcttacacctagagatttccgttcttcaaacttgtatacaggcggagtttggattaacagtattgttgacaattccaacgtctggtttaacgttgaaaatattgataattaaataagagctaggtttactaattgtaaacctagctcttatttttattgtattatttttcttctctaacaatataaattggacgattcttagtttctaaatagatttcagcaatataacgtccaataatacccagactcaacaattgaaccccactgaagaacaatataatcactgctagagaaggccatccaaaggctgcagtatgtggaaatagaattgccctaatcaccactactatagctcccaaaacagctaatacacacgttaatactcctgcagaagtaacaaacgataatggagctgttgaaaatgaaataaacccttcgatcgcatatttaagtaacccccagaaggaccaagatgtactaccggctactcgttcacgattttcgtaagaaatgtaataggtattgaacccaacccagttaaaaagtcccttactgaaacgttcacgttcgtccatagataatacactatcaaccatttgacgagtcattacgcggaaatcccgagcaccatcaactaattctaaagaactcaccttattaatccacttataaaacatgcgcgcgaaaaatgaacgaatcttgctttcgccatctcgatcttgtcttcgggtggcaacggcgtcatattcaccttcttcgacaattttaagcattttaggaagtaactccggaggatcttgtaaatcaacatccatcactgctacaaaatctcctgtcgctttttgaagtccagcgtacaaggccgcttcttttccaaaatttcttgaaaaactaatgtagtgaacttcttcatgctctttttgtaatttttttaattcaattaaagtcttatctttagaaccatcatctacaaaaataatttctggttccacatccatttgtgattctactttagagaaagcgtcataaaataacccgactgtctcctcttcattatacgctggaacaattattgataactttttcaaactacttcacctatccaaatcgttaaataaacttttcttttttatattttcatgttttacttaataagttaactttacacttatttcggagatgaaatcatgcttaaccaactatttaacaaatataaatctgttatatcctatctcttttggggcgtggtaaccaccatcgtaaatattggtgtctttgccattctatcagattacttacatctgttctaccaagttagtaatgtaattgcttggtttgtttccgtgcttgtggcttatgttagtaataaactttgggtttttaattctcatactgaaactactggtcaacttgtaaccgaagcagttcgattcttcttaatgcgaacagctactttagcaattgatattattattttatatattggaattacgcttctaaacggaaacgatattatcgtgaaaattattgataatgtcgttgttgtcatttcaaactatgcgtttagtaaaatggtcgtattcaaaaacaaacaaaaatgggattaaatcccatttttttattgttcaaatttagcaatagcttcggtttcatctaaaatttcgattcctaaagcttgtgccttagttaatttactaccagcatcggctcctgcaatgaggatatcagttttcttcgaaactgaacccgccacatctgcacctaaactaattaaacgctctttcaattcatttcgtgtatactgttctaattttccagtcaaaacaacttttttccctttgtagtaaccatcaggactttcagctggctttacacccaaatattccatattaactccgacagccttcaattcatcaatcatattttgggctacatcactttggaaaaatgttgctaaattattagctaaggtttctccaatcgtatctacagcatcaaattcttcaattgttgtttgcattaaattatccatcgttccgaatttttccgctaaagtacgcgccatcttcgtaccaaccccttgaatccctaatccattaattaaacgctctaaagaattttttcggctattatcaatggcttcaagtaagttgttaacacgtttctctttaaaaccatctaattggcttaattcctctgaagttaatttgtataaatcgtcaaagtgatgaataaaattcttcgcgtataattgttgaatttgttttggtccaagccccataatattcatcgcatttcgtgatccaaaatgctctaaacgagctacaatttgagctggacaatcagggttaatgcaacgaagggctacttcaccatttaagtgaactaatttcttaccacatgatggacattgggttggaatatttaactcactagttcctgctagacgcttttctaacactactcgtgtaatttctggaatgatatcaccagctttatgcaacagtaccgtgtcgccaatgtgaacatctttagctgttaattggtctacattattcaaagtggcccggctaactgttgttcctgccaattgcacagggtccatcaccgctgtgggggtcaccacgcctgttcgtcctaccgtccattcgatatctcgaactactgtagctgcttcctctggtggaaatttgtaggcaatttcccatcttggaatcttaaccgtgtgccctaattcttgctgaaggcttaaatcattaaccttcaaaacgattccgtcgattccataaggcaaatcttcccgttgaccttcgtatttagcaatataatcccaaacttcatctaaattagcacatacttcttgagtagggttagtgttaaagcctaattcagccatcatttgaattgcctgatgttgagttttggcccccaattgatttgaatccacaactgtataaataaatgtgtctaaatcccgcttcttagttacatttgtatttaactgtcgtaagcttcctgctgccgcattacgtggattagcaaaaactggttttccatcctctaattgttgtgcattcaatttagcaaacgaagctttaggcataaagcattctcctcgaacttcaatcgagagcggacgggtcaatttttgggggactgacttaatagtcttcaaatttttagtaatatcttcaccaatatttccatctccacgggtagagccctgaatcagctcaccatcttgataagttaatgaaattgctaatccatcaatttttaattcaacattataatcaactggatgcccaacatttttttggatacgattatcaaattcaactaattcatcgcgtgaaaaaacatcccccatcgacaacatcggttctgtatgggtaactttggtaaagccctctaaaatttcaccaccaactcgttgagtaatcgaatcctgggtgatgatttctggaaaagcttcttctaacgccactaaatccgcatatttttcgtcatattcgtaatcttcaacttcaggagcatctttggtgtaatataatttgctccaacgatccaaagtgtctctaaggttttgcgctaatttactagcttcttcaacctgcatctcttccaatttttttggtaaactcattttttctctcccatgacttatatatcaagatctaattcgactggacaatgatcggaaccaaaaatttcagtatgaatctgagcgtcagttaatttttgatccaacacctttgaactaacaaagtagtcaatccgccatccagcattattagcacgcgcattaaatcgataactccaccaagaatagactccttcttttgaggggtagaagtatcggtatgtatctgtaaagccactatttaataactgtgtaaatttattgcgttcctcatccgtaaatcctgcatttttatgattagttttatcattctttaaatcaatctcttggtgagccacgtttaaatctccacagaaaataacgggtttatgctgatttaactggtctatgtatgctctaaatgcatcgtcccaagccattcgatattctagtctctttaattttggctgtgaatttggtgtataacaagtaattacgtaaaatttttcaaattctaaagtaattacacggccttcttgatcatgtttctcaattccaagtccatatcttacagtaagaggcttttttttagtaaaaattgccgttccagaatatccttttttctccgcataattccaatattgatagtagtgaggcaattctaattcaatttgcccctcttgcaactttgtttcctggatacaaaatatatctgcatctagttccttaaaaacatccagaaatccatgcttaaccgctgcacgcaatccatttacattccatgaaataagcttcaaaatgacttcctccagtgcttatgtaattacttttattatcgcatatttcgccatataaatggaccttttaggatggtcttagctatagcaagattcgttaatttaagttatatttaaaatattcattatttttaatatagaaggagcttttatcattggttaatttgaagaaacattggaaaaaatcccttttaacttttattttagttgagttaattatgcttggttcagtaacagcattttcaggaggggcctggcattttaatattatcggtaaacgcgcttttatttttgaaatattaagtagtttaaatccgattatggagaatttagtattattaatactcgctcaaaaaatcatcgacggcgtcaatcctaaacagcttcaacataggtggtttcaaattctattttattcctttggcatttccttatttagttggggtatttttgctgttaaatttaatatctatgatttttttaaatcaatatttccaataatttttcagaccaataaaatggctactacagtaatagtgatgctttttattgggtatttattatcccgcactaataccttacttcttgaattcgacaagaaaataaaatatatcattcttttagcattatcaattatcccaactatcctctggtctttaaaattatctggtaaatctaacttcttcttcggaaccgttttatggggtgtctttctactattattagcaagaaatttaccacaaagcatgccaaaaataattaataaaaatataatatgggggggagtagttacaatattagttggaagtggtctactttatttcttagacttgttgaacaacaaaatattactgcttaactctactgacgttctcgctaatcgactatccttcttaacttctaataccgtttcattcatgattgcattatgtctttttatcttattgaaaaataaacacttaattcgtagtatctcttgggacctactttttggagcagtactattttcatctcattttttatttgctattcccttatggcggaatatttggaggaccaatttttggcttgatcaaacttcgcctagacttttggtatccttattaacttcgacaattattacttcatttatactcattgcacttgaattactaagaaagtattccatgaaacaattatcattagcttcgcctagaaaggcaaccgctctactaagcgctctaggcttagctctggtagcaaattttgccctagtaaattctaatagtttatttattttacaagacgctttttcagctattaaatcttcccaacttatgttgctaaatgttttgttattcttcgcattaatcatgattatttttgcaatttttaatagggttttattaacaagcatgattattttagcatttttagttgcatttacctttgctaatgttcaaaaaataatttctagaaatgaacctattattccggttgacatcactagtaatatccagaacatgaatgcaatacttaaactagtaaatatttggttagtagtatttttattaattttgctactaataatgattatattaagtttaattatagagaaaaaattaaaatttaattctatttttaactggtttagtcgcttttctattatattggtttgctcaatattaattggtattttccttcgagaattaccttctgtacctagttcaagtgtaacttggaaaaaagaggattatacgttctttaataaaatgatgattaacgagcttaattactcctatcatccagaaagtataaaaactgatttcaaactgaatgggagcgccgttgcactagcaagtagaatcatcgttcctatcatggataaacctgctaattattctaaacaaactattaaccaaatagctgaagatttaggaaagcaagctgattctattaataaaacccgtgaccgtaatattaaaaacgatactgttatctatgttttgagtgaaagtttctcaaatcctcaacgcgttccaggagtagaaatgaaaaatccgattcctgaaactacccaactaaaaaaacaaactacttctggtttaatggatagctatggctatggaggcggtacagctgatattgaatatgaggcacttactggtctttcactaaataactttgcaccaactttatcaacaccctatgttgagttaatccccaagcttagctatcagccttctgtgctagatatatttaaaaacaaaaatgcaattcatccttttcaacctgatctctacaatagagttaatgtatttaagaaattaggctttgataaattttataacacttctgctcctaacaaggttaaatatacaaaaactattgacggaaagaatgctactggtaatagggttagccaaaattctaagtatatatctgataaatcggcttacaaagaagttaagcgcgtcatggatatgaataaaggcggccaattcattcaattatcaactatgcaaaatcacatgccttatgttgctgggcaatacggaaaaggcaatccatttgctataactggtgatctatctgatgctagtcagggtcgattgagaacctactcatacgaaatcaaccaaaccgataaagctttaaaaaacttaatttcaatagcagataattctaagaaagacgtaacaattgtcttctacggtgatcatctacctggcctttatgaatgggctcaaaataacgatcaaaaaatgaatcaatatgattcaatgctacatcagacagactatttcatttactctaaccattctaataaaaaggtccaaaaatccgttgctgcaccatatatgtttacacctatgatgctagaacaaactaactccaaagtttcaccatactacgcattactgacccagtgtatgaaggaactgcctgctggtgaacgtaataagtacatgttagctaacggtacagagatttatgaaaagaaccttacaaataaacaaaagaaattattacacgaataccgtttgattcagtacgatataactgctggaaaacactatttaaagaaggggtctaactttttcacagtaaaataatataccatctaaacgcacagtaaagttactgtgcgtttttatatcaaaagttatcttctttagttactaaaaaacgctataattaaataaaaaaggacggtgtttttaatgaaaattagcgttgacttaattaatggctacttaccagatcaatttggtaagcatgctcccaaagcatatacatcccatgattttccaactcgctcattccctatcaatattagtgatattccgattggaactaaagcattagcattaactttaatcgactatgatgctgttcctgtggctggtttcccttggattcattggattgctactgatattgatgcaactaattatatccctgaaaatattagtattttaaatacaggtatcgtgcaaggtaaaaatagttctgtttctaaatatattgattttcatgacccagcaatcgaggcccgttacctaggtcctaaacctcctgctgatcacgactatactctgacggtctatgccttaaaagaaaagactggtttaaaaccaggattttatcttaatgatttaatgcgccaaaccaaagaacgaacaattgaaaaagcaacacttgagatcccatcgcgaggttaaaaataagctgctaccaaaggaaataaaatctttgataacagcttatttttttgtcttaatattaaggaatattttcctattttgtatagaaaacacttgttacaacgcctttttaattactaaataaaaatgaacgatttacctgtctgaatagacgtataaaagcataaaatactattgaaatccagcttaacatagctatccacagcatcattacactaacttttttaggcgtatacgttacttccataacatttttaccaatctttcctttaaccttaggaaccttaattatacctcccgaagatctagggattactggtaagccgtttaatttaaaatgattatttttataatatgcaactggtggattatcataagttccattgcccttccatgtcacaataatcttatgttgcgctacttcctttttataatttttatttttggtcggttggataattttattgttataatcccagtatacagaattatctatgctatgattagcaggcatataatccgaagttgacttagtaatataattaatatcctgttcatttaaaggctgcttcatcaaataagtaatatgttttaaagttttaggatcacgtccaatatatggtatagtagtcgattttgaaactaatacattgtggcttgcactccgattatagcgaaaattagagcgcatatttactactaagaaaagtaacaacactaggattagtccattcctaatttgtttgataaagaaatttgtacactcaaaatcaccaatgctggcaactgtaattaatgctaacactgtggctgggcctactaaacgtgctggaaattgtagtaaactactaaaaacagcactatcatgcatgatagtaggccaatcaataataatagttgttgaacacaaaaataatgttaatgataaaaaccctgtaatcttcatagctagagatatctttttaaagaagaacaataaagttgaagaaacggctaaaataaaaaacaagttaacccattttccagaaaatatttgtaaaatattataaatacccttgccatcgacaaaatcaaacttaacgataggcactatatagttaccattatataattcgaacattcccgctactacatttaatgataagcttatacaaagcaaaactgcgtaaataccatttttaagtaatttttttctagaagctctattaattattaaggcaataatagcatagataactaacaagaatactgattgaatagcagttgctaggtgtgtttgtaccactactgccataatagtacctagttgaacccaattgataggttcatctttattattaaccatccgcatgccgcacccgactaccaaaggaataagcattgcaccaatactggtaaagttctgtgccgcatcccatctaattacagctggactaaatgcgtacataatacaaaccaattggatcatgaattgattttttacctttcccattttaagggcataattcatagataaccctgataaaataaaaaaaaaaaaacgcgttacaatttcaaacttataaaaactcccgcaaataagcaatattccaccaaaaatatatgtgattaacggactatatactgatgtgaccattcgacctgagttagagaacccatataattgaataaagtaggaaaaattatgattttttatctgcatagcagtatcatatatccggttaaaatgaaataatccatctgcaccaataatcgtaatatgatggtgtatctgagggatcgttatgaatatacctatgactaatataattataagataccagtgcgtcttaatttttttatttagagcaaccatatattttctccccactaaacctttaatatatttttatacacgcaacgatattaacaataccagaatatccgtcataatgtaaaatgatattttaaattcataaattatattatttaatcaatagaacttattaaatttttagtaaacaaaaaacatcagcaaccactccaagtggctgctgatgttttttataattgtgacttttaaattatatttttagataaattggatcaatgtcattacgattggtacaacgacaatgaataaaatcgtactagttgtaaccaagttggtagcgtacttaacatcaccatgtgcttcattagctaagattggcataacagctaatccaggtgcagctgcttgaacgattaaagtttgcatttccatcgttggtaagctgtgacctgtatgtgctcctaataagatcaaccctgtaattacaagtggtgaaagaacgaaacgaccaatcaaggcaaagattgtatcacgatcaaaatgaatactcttcaaacctgcatcgtataatacgataccgatatagattaatgataatggtgtaaccaagttacctacgtaactcaatgtgttaccagcccaacctggaacaggtaagccaagtactagccaaacgatagctactaggaaaccaagtaatggaggtggaagaagtttcttccagtttatcttacggccagtagacttgtcgtcagctttcttagttggatcatcattagcaatcaagaagaccccgaaggcccatgttgaaactgtatttgttacataataaaccaagaagtaggctaaactctttgtaccaaataaagcaatattcaaaggtaatccgataaagatggtattagcattaactaccgtgttcataaatagtccacgacgacctggacgcacctttaataatttaaccgtaatccaagcaatgatgtaaccaataattactcctccaaatgaataaatcaatccacttgaaagaccaatcaacttaggtaatgttagatatttcattactgacatgaaaattgaagctggtaaagccacattcataattaattttgaaatactaccactaaattggtcgtcaaaccaacccattcctcgtaacccaaaaccgaggcccatcattaaaagaatcgtaacaatacttccaacagacgtaataaacgcagtcattttctcacactctcttcttttcacaaaaccgaaacgctcgaattcaccaacgtcctctccacagttttgcttctcttattttaattctctctttgctttctccgattgtcctgattttagtattcaggattccaacgtgtatcttcaactgcttgatcaacattatcaatcttttcttttgtaagtccttgatcaacagcactttgagcaattgccttagcaacagtattagagaaatcgctcaattttgaaacaggaggtaatacagcagctcctggttggtcaacatccacgataccacctaatgaatgagcagctttagaaatcattgtgtcattcaataccttagcagtcgaagcaatcacacctaaacctaaaccagggtaaactaaagcattattagcttgaccaatttggtaagttacaccgttgtattcaatatctcccactggaataccagtagcgattaatgcgcggccatcagtccacttaagtaaatcttcagctttagcttcagctaacttagtaggatttgatagtgggaagataattggacgttctgtatgagctgccatttcacgtacaacttcttctgtaaatgaacctggttgagtagaagtacccaccataattgttgggtgaactgctttaacaactgataatagatcagttagttcatcagcattatcaaattcacttcgtttgcgagcaaatggtttttgttctggtgtcaatgtttcatcgtcatcgaacaatagtccttgcttgtctaccatgtagaagtgcttcttagcttcttcttctgataaaccattttcaatcatttcttcgtagattcgtcctaaaataccggctccggctgtacctgcaccaaagcttaagtaaacttggtctgtaatcttttgcttagaaatgtttaatgctccaaggataccagctaatgtgataattcctgttccttgaatatcatcattgaagattacataacgatctttgtacttattcaaaatgttagctgcattatcacgaccaaagtcttcgaaatgcaagtacatgttagggaataagttttcagctgtttcaacaaacttatcaacaaaatcgtagtaacgatcacctttaatccgttcgtgacggttacctaaatacattgggttcttcaataaatcttggttgttagtaccgacatctagaacaacaggcaatacttggcttgggtcgataccagcagcagctgtataaaccatcaatttaccaacagagatatcaacaccgttagtaccccagtcaccaatacctaagataccttctgcatcagtaacaacaatcaaacgaatatcgcgtccagcagctgaatttttcaaagcttcttccatcatatctggatcatcgattgataggaatgttgcattttgtgattgtacatataattcactatagttttcaatcgtatctgcgatggttggatcgtaaacgattggcataaattcaacaacgtgttgactaaataacttgtagaataacacgcggttttcgttgaagatttgcatcaagaacaaacgcttttcaaggtcattagccttggtttgaaattgtgcataaacttgttcaacttgttcatcgattgtttggatgtatggtggaattaaaccattcaatcctaattggtcacgttcttctttagtgaacgccgttcctttatttaaatatggattattaagaatactcattgctttttcagtcatttttcttcctccagttcttatttactgtgtaagtctaatccctcgtaaaaactatagtcaaatttgttattagttataaatattttttatattaattctaaaaatgctgttataatagtatttcggaggtgcaatatgaacattaaagatttgaattattttcatgaactcgtaaaaaataaaaatttttcttcagttgccgaaatttttcatgttagccaaccgacaattagtatgtcagttcgccgattagaagaagagtttaataccacccttttcactcgcgaccaaggacgtcaccacttaaatgtcactttgagcggtcaacaactagatgaacatgttaatgcgattttggatcatatcgccattgcgcaaaatagtatcaacaatattaataccaacaaactcattttgggattaccccctattatgaccaaatacttttttccaaaaatcgctaaacagcttaccgaacaaaatctattaaaagcgattgttcccgtagaaaaaggatcagctgagttagaaaaaatgctgttaaatggaactttggatatgtcattaatgggatcagttcaaaatgaacatcatcgaaatttagcctaccaacacttgggaaaagaccattttaccgctatcgttggtaaccaatcacctttctttaaacgtgaaaagatttggttttctgaattaaagaatgaaaaatttcttacttttgatagtaacttcgttcattctgaagccttaaaaaattttagtaaaattacaaactttcgacctaatatcgtctatcaaagtaacgacgctcaggtcattcaagaaatggttgctcaaaatgttggagtcggatttatcgccaattcagcactcactacccgcccagatattaaagcattgcctttttatgatgaagaccaacctttcttctatatgaatttggtccaacgtaaagaccggattctaagtcccaatcaacaaaagattgccgatttaatttatggaaattcgctaatgaaataaaaaagtttgatacttgattaaaaatcgcgtatcaaactttttttgaatctactttagaaacgtgcatatcctaaagcatgttgcgcagctaaattaattaaactccattgtcggtcgtagcctggttggaagaagaaatctgcttcagccaagtcttctaccgtcaatcggtgttccactgccaaagctaaaacatttccttgtgccgtcatgtcagcggtcgaaagtaccgcgccgcctaaaacaatgtgggtatggggatcaaacgtgatatcaacatcaacgcgcacatttccttccgccttgggaacatacgcggggcgaatatgatctacgtaatgtgagttaacaatttcaacattagaacgttctgctgtaaattcatttacaccggtcgaagcaaaatgttcgtcaaacacatgtaaggctgatgaaccaacaactcccttaaaaatttgagttggtttcttttcaaaaatatggttcacaacgtattgagcttctcgacgggcggttgtagctagggcaatcggcgatggttttccggctggaatcgataatggtaagatcgcatctccaatggcgaatacgtctggcacattggtcctcaagtatccatctacattgatgaatcctcgatcagtcaagtccacaacgcccttaagccattctgtattaggttggacacccgcagcttgaattaccaaatctgcaggataacttccctttttagtttctacactggcaactttatcatcgcctttaaatgcagtgatactttggctcatttctacttgaataccattgtcagttaatgttttatcaataatttccgtcatttcatggtttaggtaatttccgaggggacggtcgatgaaatcgaataaggtgacgtgtttacctttcttagcaaatacttcagctgcttcaattccaatatatcctgaaccaattacggctacgtttttaatgctatcatcagtcaaggcagctttaatcttagttgcccagtcataaccacgcattaaataaacatttttaagatctgtgcctggtaccggtagattcttaggtgttactcctgaactaagaattaatttatcataagctacttgttcttctgaacctgctttcaggtctttaactgtcacctgtttttgatcaacatcaattgctgtaacttgatgattgttataaatctttccacctttagaagtgatatcctctggccggaaatttcttacgtcattaacgtctgtaacttggtcttctaaataaagttgcatcccacacgacataaacgatacgaaatctcccatttcatagattgtaacatcgacattatcgtatttatctaatagctcaatcgccgattcgtgccctccatgtgatgccccaacaatgataactttcactttatccatctgtattgtccccctatttcttaatattacgtctacagtctaactctttttgtgaaccgcttacaattaaaacgcttataaactacaaataaaaaaagccattaacctatctctgtagtgacttccaatagctagatttttggtctaactttttggtgctctagcatctttgttaatgacttttgattcagttattaaaatttaaaccacgcatcgatttgacggtattcttgatcgcttagttcgattgcggtagctttaacgttactttttacctgttctgctttacgagctcctggaattacaacgccgaggttggggttctttagataccatgccaacactacttgagctaccgttgcatctttactttcagcaattccacgtactttctcaacggcatcgatgattcgatcaaattccgcttgggaatattggttgaactttccgctatctgtcttagcatatttaccagtcaaaattccagaagctaatggaaagtatggaacaaaagtaatattatgctcatttaaatatggaattaattctttttcagcatcacgatgcacaagactgtaatgatcctcgacaacgtcgataacatcatcagcattggcctctttaatttgctctaaactaaagttagaaactccaatggctttgatcttacccacatcccgtgccttaactaaagcttcaattgcttctgctttgttagtggtttcgtctggaaagtggatataaaaaatatcaatataatcggtttttaatcgtttcaaggcatgatcaatttgttgagttaaaaattccggattattgttaggtttataatcatggtttacgtcctgagctgccttagttgcaatcgttatattactacggtcataatctttaattacatcaccaatgatttcttctgaacgaccatacccgtatgcataagctgtatctaacaacttaatgttgctatccaaagcggttctaactacttcgtaaccatcttgatcttctaatccttcaaacaagttatgtccaccaactttattggtccctaatcctaaagttgtagtttcaactgcacttttaccaattttgatttgatttaacattgtactttcctcctatcatctaaacatggttagaataacagaaatcgattttacaaactaacaatatgcgacaaattatagtttatctactgtgtccattaatgatgcaatcgatgcatcctcagacttacgatcaatcttaatcacgttccaaccagcatcttgggcaggtttcaaatctttaacttcatctacggcaacatgaacatgtttctctacatcattgccgagttgatcattaacatagtcaaagaatttttgattaggcttatatgtctgaacatcttctgccgtaataatcatatcaaattcatgatctagattaatcacattactttgaattaaatctctagaatggttcgtcattaatactgtttcatagcccttagctttaatttgataaagcgcagtcggtgcatcagggaaaggcttcatcacggtatgagcaatcaaaacatcactaaagtcactagggtcaactttaaatcctaactcatctgccgtttgattgagggcttcttccattaacttagagtattttacaaactcatcagctttcatcaaagctaattctttttcaacgtaagtgttacgaactaaattatcgtcaatattataacgttcacctaatcgaccaattgctctgtaaaaaacttctgtatcaaataaagtatcaaatcctgcaaagctaactacttttttcattattgaaacaccatcctaaatctatttccttctattataccgtttttatttatcaaataaatttgaacattttcagcttcttcgtatgatactatagaaataactacgtttgaataaggtgtgaaacaaatgcatttgaaaattgaagatactcgattatctactttactaaactctatttttattggaattttgattggtttaattgtcagcacatttagactagcaatcgaacatcttctagaaatttcacaatcaatttatcgactagccagttccagttggcattggttggccctgattgtagtaattaatattattttagcagtgttggtaggattgttagttaaaacttctccccaaatatctggctcaggaattcctcaaattgaaggacaattatctggtgaatatgaagaaaaatggtggccagtactttggaaaaagtttactggtgggattttagcaatcggatctggcttgatgctagggcgtgaaggcccttctattcagttaggagcggtagtaggtcaaggttggagtgaaaccctccactatagtggttctcaacgtcgcgttttaatcgctggtggagccgcagctggcctttcagctgcttttaatgctcctattgctagtactctattcgttttggaagaaatctaccataacttttctccgttggtttggattagtgcccttaccagcgccgttgtgtcaaactttgtttctcttaacttttttggtttaactccagttttagcgattagatatcctcattctttgcctcttgggctttactggcacctaattgccttgggaattttactgggcctttttggacgactatatcagctttgtacattaaatctaaaaaaatggtatcaaaaaattagctttttaccacgttggctccatagtttagtgccttttataacgattattcccatcggaattttatggccatcatatttaggtggtggaaattccatcattactgcaattgctaacaaaaatccgatttttatgacgcttttcaccctattaattattcgattcattttttccatggtatcttatgggtctggattacccggaggaatttttcttccaatcctaaccctgggtgctatatttggggctttgtacgttagtatcatggctaatcttaatctaattgatatccattacttacccaactttgtgatttatgccatggctggctactttgccgccattggtaaagcgccatttactgcaattctactgattactgaaatggttggttcgctacaacatttaatgccactagccgttgtggcgcttaccgcctacattgtattagatttactcggcggtgaaccaatttatgaatctttacttcatcaattagttccaactattactgctactcctagtgggcctcaagaccgagtagaaattccaattgtcgaaggttctaagctggatggtttagcagtccgcaatatttcttggcccaaagaaagtttattaattagcattcgtcgcggctctaattcaattattccaagtggtgattcagtaattaaacctggtgatacgttgattgttactactcatcggggaaatcgtaaaaaaatcgctgcccattttgcaaaaataaactaaaccactaaagaagcatccaacagcacttagcgtgctgcttgatgcttctttttatagtgagtttacaaccagttcctttattttcaccaaataatgattgaatcattaattaatagcacttttttgtcaattatccgcatcaaaatcccctataacagtcacttcggatcataaaatgatattaactttcaaatagtaaaacatttttttaaaaaatgataaatattagacaatatttcacaagcgtttttgttttttaattattaaaaacgatttataattaacaacgagatctttagaaagcgctttcttgaatcttaacaaattaaaaaaacggaggtacggacatggcagacaaatatattcttgccatcgacgaagggacgactagtactcgtacaatcatctttgatcatgctggaaataaaatggcagatgctcaaagagaatttccacagtactttccgaaacctggatgggtagaacataatgccaacgaaatatggaatgccgtattgtcgaccattgctaatgcatttatcgagtcaggaattaagcccaaccaaattagtggaattggtattaccaatcaacgagaaactaccgtgatttgggataaaaagaccgggcttcccatttataacgctgtagtgtggcaatctcgacagacagcagaaattgctgaacaactcgtaaaagatgggtatggcgacatgattcaccaaaaaacgggactagttacagacgcttacttctcggcaaccaaaattcgctggattcttgaccacgttgatggcgcacaagcacgcgccgaacgcggcgagctgttgtttggaaccattgatacatggctaatgtggaaattaacggatggtgatgtgcacgtcactgactattccaacgctagccgcaccatgttgtataacattcacaaattagaatgggacaaagaaattctcgctttacttaatatccctgcttcaatgcttccggaagttaaacctaactctaccatttacggtaaaaccaaagattaccacttttatggtagcgaagttcccatctctggaatggctggcgatcaacaagcggccttatttggccaattagctttcgaacccggaatggtcaaaaatacctacgggactggtgcatttaccgtaatgaacacaggtgaaaaaccgcaattatctgataataatttattaaccaccattggttacggtattaatggcaaagtctattacgcactagaaggtagtatttttgtggctggttcggcaattcaatggcttcgtgatggaatgaaactgtttaaaaaggcttctgaatcagaggcagccgctgttgcttctcaaaatgataatgaagtctatgttgtaccagcttttaccggactgggtgctccgtactgggatcctaatgctcgaggttcagtttttggaatcactcgtggaactacccgtgaagatttcattaaagctacccttcaatcccttgcataccaatctcgtgacgttattgacactatgaaaaaggattcgggaattgatattccttccattcgtgtcgatggtggcgcttctaataatgattacttgatgcaattccaatctgatattttaggaattgaaattgatcgtgctagtgatctcgaaaccaccgctctaggcgccgcatttcttgcgggattagcagttggattctggaaagaccttgaagatttaaagaaagaatataagccagggaaggtattcaaaccaaagatgtcaactgatgagcgtgaagacttatacacaggttggcaagaagcggttgcagcaactcgtcaatttaaacatcgaccacgacaatcaaaataacttaggaggcttatttcatgtcattctcattaattagtagaaaacaagatatcgaaagattgaaaaatgaaacgctcgacttacttaccatcggtggtggaatcaccggcgcaggtgttgctattcaagcaagcgccatgggtatgaacaacgccctaattgaaatgcaagatttcgctgaaggaacatcttctcgttcaaccaagttagttcatggtggaattcgttatcttaaaaacttcgatgtcgaggtagtttctgataccgttaaagaacgcgcggttgttcaaggaattgcccctcatattcctcgccctgatccaatgcttcttccaatttatgacgaacctggatcaacctttgatatgttttcagttaaaattgcaatgaatttgtacgatcaacttgctggtgttacagatcctaaatacaccaactacactatttcaaaagacgaggttcttcaacgtgagcctcaacttaatccggaaggtcttttgggtggtggtgtttaccttgattttcgtaataatgatgctcgtttagtgattgaaaacatcaaaaaagctcatgaaaatggtggcttaatggtcagtcatatcaaagctcaacacattctgcatgatgaaaatggtcgtgtaaatggtgttaacgttaaagatctcttgactggtgaagaatttgatattcacgctaaattggtaatcaacacaacgggtccttggtcggactttattcgtgaaatggatgataaagaagaagttgttccacagatgcgccctactaaaggggtgcacttggttgttgatcgctcacgtctaaacgtccctcagccaacttactttgactctggcaaacaagatggtcgtatgattttcgcaattcctcgcgaaggaaagacctattttggaaccaccgatacagattacaaaggcgacttcttgcatccacgagttgagcaagaggacgtcgattacttgttaagtatcattaataaacattatccagaagctaagattacgattgatgatattgaagctagttgggcaggtttacgtcctctaatttcttccaatggtagctcagactacaatggtggtaattccggaaaaattacttcggatagctttgatgaagtcattgatattgtaaataagtatgaaaataaagaagctgatcgagttgacgttgaagatgtccttaataatctagaaagcaccctctcagaaaaaaatccttctgctgtatctcgtggtagcgccctcgacgttgcaaacgatgggctaatcacccttgcaggtggaaagattaccgattatcgtaaaatggctgctggagccattgctttaatcaccaaagttctcaaagaagacttcaacgaaacattcaacgaaattgattctaagcatctccaagtttctggtggtgatatcgatcctaataacgtcgacgctaccctttcattcttcgctaaacaaggaattgaaagtggtctatcaaaggctgaggctgaacaaatagctaacctatttggatcaaatgctgctcgtgtatttagccagattggtaaaattgaagcagcacctgggctaacacttgctgagacaattagtctacattattcaatgaatgaagaaatgacgctgacacccgttgactacttgctccgccgtaccaatcaccttcttttccaccacgatacaattgatgatgttaaaaagggtgttattaatgaaatggctcgttacttcgaatggtctgacgaagagcgtgaagctcaagcgaagaaactccaagaaacaatcgatgaagctagccttacttacctaaaataggaggaaccttttcatggataatagtttatcgcttcaactactgggggagtttattggaacatttgtactagttttacttggtgacggtgttgtggctggagttagccttagaaagtcaaaagctgaaggctctggttggatcgccattactttaggctggggattagctgttacattaggggtttatgcatcctcttttctcagccctgcccatttaaatcctgcagtttcagtcggaatggcaattgccggtaaatttccttggtcaagcgttattccttatagcattgctcaaattttaggtggtttagttggcgggattgtcgtttggattcattattacccacattggaaagaaaccaaagataaagatgctattcttggtacctttgctacagaacctgctattcgcaattacagcatgaactttattagtgaagttgttggtacagcagtacttattttcggtttattagcctttactcggggacaattcactcagggtcttaatccaatcgctgttggggttctcattacagcaatcggactttcacttggtggaactaccggttacgccatcaatcctgcgcgggacttaggtcctcgtctcgcacatgcgatgcttccaatcgctaacaaaggcggctcagattgggcctatagttgggttcctattttgggaccagttgttggtgccattctaggagcaatttgcttcaatttgatcccttaacaattaacactttataattcatgcaccctttttaccctttatgcttaatattaaagcagcaaaacaccggaatttaaattccggtgtttttattttttaatatattaaaacttgtgctactaggattcctccgccaaatactaataagaagaccaccacaggccatacaaatcttaaccagtgtgaatactgcatgtctaacatttgcaacgtcgccattactaatccagttggtgctaagaataacattgcatattgaccgaattggtatgctgttactaccacaaatcttggtatttcaactgtatcagccaaaggggccaaaatcggcatcgataagactgctaatccagaagaagacggaacaatgaatcccaatacaaaataaatcaataacatcacaataataaatattggaccactcatgttagctactagagctgaagagaaatctagaattgtatcagagatcatcccctcgtttaaaataaggttaattccacgtgctagcccaataatcaaagaaactcctaccaaactagatgctccattaacaaacgcatctacgacgcctttttcaccaataccatttgctcctgtaccagtcagaaacatgataataatcgcaaatgctaagaacgaagacgccatggttggaaaccaccatccctgtgtcattaccccccacaccatcagtggaaatccggcaacgaataacaataaaataattttcttccgtttagtaaaacttgcctcactgtcatcagtactttcaaccgaccacttactattgaacgtgttacgatcttcatacgaatatgaaaactggggattgttcttaactttttgactataccagtataaataacctacaacaaaaatagctgccactatgcatccaaacacacgccatccaattccttctgtaaaattaattcccgccgcattcgatgcaattacgactgaaaacggattaatcgttgaaaatgctgttccaatcgaacttgctaaaaagattgctcctacacatactatggaatcatatcccattgcaatgaataccggcactaaaattggataaaaagctacggcctcttcttcaatcccacacaacgttccacctaatatcatcaaaattgctaccaaaaaaattaataaaaattcatgacctttagttttcttggttaacgcaaccagtcctgattcaaatgctccactagccctaacaaccccaattaacccgcctaagacaaagatgaataccataatgtctacagcttcaattgttccacgtaccatactcgtagtcactttagtaatactagctggatgttgcttcaaacgctgatatgtattgggaatcgaaatttcttgcgtaatccctcctgaagtaaatttttttatatcaatcttaactcccaacttatttaattccttttgagtggcaggcaccttatgaacctcgcccccaggatctttaacctgcaaacttgaagtagtctgattataggctaacttagcataactaccagaagggactgtccatgtcgcaataactgctacaattgttaaaataaataaaattacaaaggccccgggcatttttaacttaaaacgtcttttggctttactggtcatttttatcacctcatattttatgtggatataaaatatggccttaagcgtcagacaccattttggaagttaaactttctatacttaaaacgcttcaggccatatattaaaatttcttgaaacttatattttttcaatctactactttaaattatttacttaattaaaaatgatttttaaatatgatctctttgagcctatacaaattttttgttgtttaatggatgtgagaaatatacaaatctccgacacactctgttatcaaagcttgtataagcctactcgaagtggttaatgttttagttcgctggctaatgcttccatatcttgaatttctttaatcgttgcacctttatttttctacaattcaaactataatttttcccattatcactaaccccattccaattagagcaccaattgttataaatactgttactatcaattctcccttagagaggaaatattcgtgtccattatttttacgagcccgaccataaaaataaattccagggatgtatgcaataaaacatagcaataaataacttaaccctgccattaaaatgcctattacttcaaacaacaaggctaggacaccaattaccaattgttgctgatttcctttttcatggatatgtgtccacgaatatttaatctggtaagctgcaaccaggatataacacacaatcaccgctgcggtacaaagagaataagcaaaattgtatgctttagttgtaaaaaatagggtgaataagaaaatctgtattaatccagccgttaaaattaaggcaaaggtgggagcttttttatcattaattttcccaaaatattctggtaatagtttttgctttgccatcaataacattgtctcggctggtaacatcgtccaggaaagccatgcacctaggattgatacaattaatccaattccaatgaagtatccaccccaagtaccaaccatcttttcaaatatatatagcatggctggttgtttaatcgttgccaactgttcttgggttaaatatccatatggtaaaactgatgccaaaatgtagataactagcaagctaattaaacccaaaatggttgcttttcccgcatccgatttcttttcggctcgtgccgatagtattgaggcaccttcaattccaacaaaaacccacatcattaccatcatgcagttcttaacttgacctataacatctccaccaacaaaattattattcatattattccaaaaggcatgcgtaaacattccgcctttaaaaagaataattccaaatacaataaatacaaataaaggaatcaatttgcatacggttacaattgtattaattatggcagcaccttcgatgccacggttaactaaatatgtcagtccccatgaaaagatacttgcaattagaattaatggtaagtttcgttctgacctaagaattgggaaaaaataacctattgtgctcattagaaaagttgcaaatgccacactgcccagccatgctgacaaccaatatccccaaccactaataaaacccatgaaaggaccaaatcctttcttgggataggaaaatattccctctagctctggttcttttaataataagttatttaacgataaagccagcatcataacacccaaaccaacaataaaccacgtaattaaaaccggtcccggcgctgcagccctcgcaagatctgacataattccaaaaacaccactaccaatagatgaactaatcactagggcactcaaagttaataagcctattttctcatttttctctgtcattcaaattactcccaaaaattttaattagttatttgatatacgtgatgcttcagaatatttatctaaattcttcgtaacttaaattagtgtccaataccctatataatcaaaaaaatcatatttcgtcttaatttcttaggcaaattatacttttaacctgcttaattagctcacaacaattgttccattaactaccaaataaatggcaatcaaactgagaatcaaaatcatccccatcatacctttctctttaccagttaaagtacgtttattttctttcgttgcttgataatagataatgaatcctgggatgaaactgatagagactaacaaaatttgttgccaaccagatagcaccatgcaggcaaactggaataaagctgcaattaagccaattgtccactgtccccattgcttttccttgtagctgtatttcatttgatacaatcccacaaataggtaggagaataaaatagctgctgaagctaatgaataagcaaaattataagcttcggaggtgaatagcaatgagaataagaaaatagtttgtagaaccgctgtaatcattagtgacgttgttggagcttttctttcatttaatttaccccaaacttttggcataaccttatctttagcaattaacattgtagtttcagctggtaacatcgtccacgataaccatgagataaccgtagaaatgatcaaacctatattaataatcattgcgccccaactaccaacaattaattgtaaatcatttcctaaagctggttgttcagcacccgccaactgggcacgtgttagtgttccgtaagggataattgaaatcatgacataaattatcagaagtaaaacaaagccgataatcgtggcttgctgagcttgacttctagttttagcacgatggcccataactgaagcaccttcaacaccaatgaatacccaaattaaagttgataatgttcccttcaattgttcaaaaattgatccggttgtagttcctttggaaaagttattggtaacgtttccccaaaaatcagttgtaaacatgtgacctttaaagaaaataattacaatgataataaacaaaactagtggaattatcttaaagaaagttccaatggtgttaacaaacgaagcactttctaccccacgattgacgagtagagttaaagcccaacagaaaataattgctacaattattgatggtaagttttggccacccttgaaagccggtaaaaaagttccaatcgcgctcatcagcatggttgcaaaagcaatatttccaagccaagctgaaagccagtaagcccatccagaaatgaattcacctaatggaccaaatccagctcccgcataactaaaaattcctgcttctaaatcggggcgtttttcagataaattatttaatgataaaactaagaacaaaaaaccaatcccaacaaacaaccaagacaataatgctggtcctggtgcggcagcagcggcaaccgcattggtaattccaaatattccggttccaatacaagagctaacaattaaggcggttaagcctagtcgcccaattccgtttttattttccatgttcttcactccattcttaaatttaataaaaatggcaaaagtaaactgtctactattttctagtaccacagttcacttctgccataaaattatttttagatgtcttcacgaacaattgggcaggacatgcaccgtggaccgccacgtccgcgagataattcacttgaacgaacctcatggaccaggataccgtgttgacgtagtaagtcgttcgatacgtaatttctgtcgtaagttacaacaacgccaggagcgattgataacgtatttgaaccatcattccattgttctcttggagccacaattgaatcaccattaccagtaggaattaagtcaatttcagacttattaagagccttcttcaagacttccttaatgtctgtatgatgttccattgtaatctcaccatctttaccaggatgaagtacccagttatcaacttttccatcaccagttaaaattgctggatgtactgtaaattgttcataattaatcatcgtaaatactgtatccaaatgcatcattgcatgattatgaggtattgaaattgcaataatcgtgtcataattagaatctttgaataaattacgagcgatatcttcaattgcattcgctgtcgtacgttgagagataccaattgctaatacatgatcatttaaaactaattcatccccaccttcaatatgggtacgatgattacggtctcgccataccttgacttttccagcaaagcgaggattgtagttcatgatatattcggtaattaaggactcccgcatgcgtgcttcaaaagtcatcttgttgatagataacccatctccaattgatgcttggggatcgcgagtaaagtatgcgttaggcattgggtccattaagaaaggccaatctgtattctcagaaacggattgtaagtcaggagtaacaatattaacatcgcttgctcgtaccccttcaataatttgattaatcatcatctgaggatccattgcgtaaagatattccattaaagcgtcatggattactccaactgcatagccagattcagcaatcattctatttaagaattcttttcttactccatcgtcacttaaagcatcagctgccaatttttcaaaataaatcacttcaatcccttgatctgtcaaggtcttagcaaaaaagtcatgttctttttgagcgattggtagatatggaatatcatcaaacaataatctttccatcgaatccggggtaatattttcaatttctttacccggacgatgtaacataactgtcttaagttttccgatttctgaagttacatgaattgcgttcgccactataatcacactcctattcttattttttctacctggtacttaaataaattatttagccgtgaattactgtacctaaattacctttcaaagcgtcatccaaaccatttaatgaggtaataattgcttcacgttcagggtgtcccttaacaaaagataagcatgcctgtacttttggtagcatacttccagctgcaaattgtccgtcatccatgtacttttgggcttcttcaacgcttagttgcttgagtactttttgttctggcttattatagttaacgtaaacatagtcaacagctgtgagaataattaatttatcggcatcgatgttatcagctagcaaggcgctcgaacgatctttatcaattacagctggtactccctttaagccagtttcagttttaatgactggaacgccaccaccaccgccagcgattaccaaatcaccgtgttcgacaagcgttttaatactattgatttcaataattgattttggtaatggagaagctacaacttggcgatatccacgtcctgcatcttcgacaaatgtatatcctttttcagcttcaatttgtgcggcttgttctttgctgtagaaatcacccactggtttagtcggtttttgaaaagcagtatcatcttggtcaacttcaatttgagttatagttgtcacaacatttttatccatgtttcgttttgcaagttcattttgtaaactttgttgtagatgataccctatataaccctgactcattgccccacactctgggaacggaaaagctgctgttttaccatgttcggcggcgtagttcatcccaagattgatttgcccaacttgaggaccattcccatgactaattactacttgatgatcatcacgtaccaaaccaatcaatgatgcagccgtatttttcactaactgtaactgttcctcagggctctttcctaaagcattgccacctaaggcaaccaccatttttgacataaactcgccctccttagtcacctaaagttgcaaccatgacagctttaattgtgtgcatccgattttcagcttcttggaatacaactgattgactactttcaaagacttcatcagtaacttccatttcagatagaccatatttttcttcaatctttttaccaattgatgtgtctgtattgtggaatgcaggcagacagtgttcaaagattgcatttggattttcggtagcttccatcacttctttagttacttgatatggcttcaataatttaatacgcttttgccacatttcatctggttcacccattgatacccatacatcggtatagataacatccatattcttaacaccagctttaacgtcattttcaacaacgattttaccgcccgttttagcagcaattgcgttagctttgtctaagacgtccttggttggttcaagttctttaggggttacaacgtgatattccattcccattacagcagcacctagcatcaaagcattagatacgttgtcttgaccgtctccaacaaaagcaaatttaatatctttatattctttcttcaaaacttccttagccgttaggaaatcagctaaaacttgagttgggtgatcttcatcagttagaccattccatacaggaacacctgaatattcagctaacgtttctgctgagcgttgtgagaatccacgatattcaatcccatcaaacataccacccaagacacgagctgtatctttaactgattctttgtagccaatgtgtgagcctgaaggaccaagataagttacgtgagcgccttcatctttagcaccaacttcaaaagcacaacgtgttcgagttgaatctttttcaaaaatcaaagcgatattcttgccagccaagcaattaccttcatagccggcatatttagctttctttaaatcctcagctaaattaagcatgtattccatttcacgagtactaaaatctgataaggttaaaaaactgcggttacgtaagttaaatgacattttaacgtcctcctctatatttgattacgtgtttaattctagcaagcgctttcacaaagcttcagtgatcaattgattttcttaaaaattaatattatttttatttaaaacgttttcataaatgaatattttttgaataaaatcacttattttttgaataaatattttatataacaaaaaaattgtcatttttttcatttttatatcttattattgtataattcataaagtatcatataacttcaaaaaacttcaaaaggagatccgactatgaacttttatttactatcagacgatgaatcaagtgtttccatcgttcaaaatattattgaatcggattttagcaactcactagttggagttaatttcgatgttgatagtgcctatgacgatttattacaactaagagtcgacgtaatgatcatcaattgcttagaaatttttccagaagggctaaatttgatcaaacgtctcgctcaagtccacatcaaacctcactttattgtggtgggacctcataatgaagcctataaagacgaagcttatcgtgtaggaattgacgcttatttagattatccttttaatcatctggagtttaaaaatattacgaagctagtgggttcttactgccaagtagttgataaaatggctgaaattaacaaattaacgtctggaattgccacaccatttaatcgaccacaatctaagcatcgtcttcgaaccgatcgaatccattcaatcctccgctttttagggattgcttctgaaaacggttgtgatgatatcttacggattgctaaagttatggtcgatcaaaatattcctttctcaaagattgattttcaagaaagtctttctttaaatgaacatgagaaaaaaagtgcctttcaaagaattcggcgtgccttacgtgttggtatttgcaatttagccggtatgtgtattgaatatcccgaaaatgaagttctgctagaatatgccaacagtttatttgatttccagaacgtttataatgaaatgcaaagaattcgagaagtcggagcccaacgcggtcaaatctcgattcaacatttcttcgatggattattacaagagagttatcgcgaagacacatagtaaaaatatgaccctaaaataaaatttattcccaatactagttaaaaatttcttcagtccataaaaaaagaacccaactaaattaaatatagttaagttcttcaaatagtttaaaagatcaattttattaaataaaaaacatggtacaagtaggataaattacaagtatcatgcctaaattgaatgtataaaactagatgctccccattttaactcggggagtttttttatgactttaattccaatgtcttagtttaaatattataaaattcgctttaattcttcgacttcttcaccaaatagtttaaatgcttgatcaagatagtcacgtttggttacatctaccccagcctgtttaactatttcgaccggataattacttgctccggctgataagaatttcttatagttttccaatgcaccaggtttaccagaaataatatcatcggctaaagcggttgcgatggctttagatgtagcgtattggtaaacataataatcgtaatagaaatgaggaatttgcgcccaagtatcgtctttccaaggtaaatctgttacagcatctccattatattctttgaacaatccgttaaatttatcagccatcaaatcgggggtaagggtcgttcctttggcatcttctgtataaataaaatgctcaaattccgcaaaaagagtttgacgataaaccgtgccaataaagttgtccacatcttgtgttaaaataaatgctttaatttgaggatcatcagcatatttttctaacatataatggtttaataagctttcgtttaaagttgaagcaatttcagcaataaagattggatattgtgaataccagaaaggttgggccttatccgtgtaaacactctgaagtgcgtggcccgattcatgggctaacgttgaagtactatcataaatatcattccaatttagtaagatatatggatgcactccataaacgtcgtcctcatagcccccactacgtttccctttattttcagctgcatcaatccaacgttgttcaaattcctcttgcaaataattttgataatctttgcctaacggagccaaggctgccatcgtaacctttttgccttcttcaaatgccaaacttaacttagcatctgcaaccaaaggaacatgtcgatcaaattgatacatatgatctaatcctaagtatgcttttcggaaagcataataatcatgcatcaaatccagatgttcatgtgtcgtattaatcaacgtatcgtaaacggcttctggaattttttgatcagccaaattcatctgacgtgcactatcaaaatgcctaattgtggctaaaatattttgggcatgaacgtggcttttaagggtagcaccaaaggtattccgcattgaacggtacgccttagcaacttgtttactagcacgcattcgcatgtcctgatctgctgaagtagcaaattcactggctgtagcattagttaattgaacttcttcgccattttcatctttaatcattccaaaatctaaatcagcgtcatctaatttcgaagaaatgtctgaagcatcatcaatcgccggttgaagttgagccaacaatttttcttcagcaggagtaagggtatgggcagcttgctcttgaattcgacgtaaattaaattcatatcgttttaattctggcttatcatctaaaaattgatctaattgcgctgctgatagttgcgttattttaggatcataaaatgatacggctgcttcccacttattaacaattaataatgcttgattcatcaaatcgttcccatgtgggtcagcagtatcaccatcattaacccgagccgcatatccataaactttcataaggagttcttcactctcataaagtaattcagttaatgctaatagttgtgtagcactctcggtcatatgtctagaattggcttgaatttcaacaatttgtttttcaacttgttgaatggcctttttaaaatctgcttcagttgtaaaaatatcggtgacgttccaagttaacgcttccggaacctctgcccgtgttagttgtttttttgccatgtaaaatcctcctaatactattgccttttattttacaacttccgaaactatacacaacttaaggcacttaattaactgataaggggcgtgcattgtgttgaactaggatttgattaatcttagtaatatcgaaaccctctaacgtcgctaaattttgagtcgtcggatctgattttaaaagttctcctaatgtgactgataaattgtgcgggtgataagtcaacacggccgctaagcatgttgataacatccggtcgtctcctcttttaatttcccagttatttgcgatttcatctgttaatttaggtactaattcttccagattcattgatgggtaaaaccaaaagtttaaagctcgatctcttagatactcatcaatttcccattcgtcactctcccgtgcttcaaatgtatcatcgattcctcgagctataatttcagctaattgatacttacccgctggtattttatccattccaattaaatttgttgcagctttttttagttcatttaaattgctattagttttaatcatgattgtacccctccattattagattgcttacgctttcattgtataacattttcaaggaataactatcttaatatgaaactttccaaactatatcaaacaaaaaactgtaaccgagcttgatcgccctgctacagtttttatcatctaccgtgtttcttttttcatcacatgtcctacgatgaaagtaattccataagatatgaataaaattacagcgacaatcatatatggaatgtgagtattgtaatccatcaacattccggcaataattggtccgatgacgttccccacactagttaaagacatgtttaatccattaattaagccttgattgtctttgccttccttagttaataaggtggtgatggccggacgtaaaacatcgaaggcagagaaaactactaatgtagcaatgattacttcaatttgagtatgagcttgggtaatccaaaaaacaaaaattgctccaattaagaagcatgccccaatcagtctcacttcacccattttccgcaccaagaaatcaaagataaacacttgcaaaatcaacgagaaaatcccattaaaagtcaatactagtgcaatcgttcctaaactaaaattgaagacttggttaacgtagatgctataaatactttcgaatccctgtaacccaaaggctgctacaaaaatcatcgtaaatagaattactagcggtgccgtcatgacactcttcaaagcattcggcttagtaaacttggtcatttccgtttcttctattttcacttcagtcttcggcattaccaaatacgtaaataatgttgaaaccagccctaaggccgcagccgcccaaaacggcactttataatggatatttgctaatacaccaccgagccctggtcctaaaattagtcccccactaaatgcggctgaaatccaaccaattaccttagccctttgcgccgtagtggtaacatcagatgctaaagccatcgacgttggaataaacaaagcggctgaaatgccaccaacaactctggatacgttaaatagtaataacgaatttgataaagcaaagattacttccgaaacggcgtagaaaaataatcccgctacaatcagtggcttacgtccaattttatctgaaactcgtccaactaatggagaagcgataaattgcgagaaagcaaacaatgccgtcataattcccatttgagtagtagtataaccgtaatgattcttaataaatggtgtgacgggtatgactagaccaatccccaaacaaattaagaagtttccagcaattaagatatataatgtctttctgtttttttcactcattgtaattcatctccttcgttatctgatacattctttcatgataacactcaatgaataaaaaagctcaagctcattacctatatcttacggagaccataattaccagtccaaattcaccttggtaatttcaccgttattaaaagctttaacttgtccatcatccaactttacgacgatatttccatactcgttaatatccgttgcaatcccctttacttgtttcgttccgacttgtaaggtaactggcttaccaattacgattgacatttttcgatactcggacaaaaagctgccatctaaataattttgccaattatctacaatcgtattaattaattgggcggcgattagattacgatcaatgttcggttcatttttagcaacaatggctcccgctttttgttgtaattcttctggaaattcaggcgtggttaagttaattcccaccccaattacaaacgcttgcgtagaagcagattctacttcggtaattgcctcagtaataattcctgctacctttcgttgattcattaaaatgtcgttaacccatttcaatttaaattcacgttcagggaagaaatctttaaatgtttgtgcaatcacataggcaaccccagtagttattaagcccacctggttaatttcaaaagtgggcttagggataactatgctaaagtaaagtccttgttctttgggtgagtaaaaactacgtcctcttcgtccgtatccttgcgtttgctgctcgctaatcacagcaaatgccttttcgacttggtgagtagcgagatagtttttagcatacatttgagttgaatcgacttgctcttcaacagcaacatgatcaacacttttatttttataaaaattaatgactacttcatccaacttagagctactttcatatttgtaacctagatttttctgactttggatttggtgaccgcgtttctttaataggttaatatttttccaaatcgtttcgcgggtaacgcctagactatctgctatttcatttccagatacccaacgatctcgatctttcaataattctaataaaactttttggcttgttttattccccatcttataaccacccttaatctatttaactagtttaagtgtactatcttctccaatcgattggctatgataattactaaaatagctttgattgtatcacctgggataaataataaagtagaaaacatggccgttgaaagtggcatgggtgcttgaatcgctaaccagaacgcaccaaatacatcaataaaaactgctcctccaagccaaacagaaagtaaactaagtattaattgattcttaattttgcctttcaaagcattcttgattaaattaattactagtggcgcaaacaaccaagccactaaatagcccccggtagctcctaaaaatactacggcgccacctaaaccaccggaaaggattggcaatcccaaacttactaataataaaaatattcctactgataacgttccatatctagtacctagcatgtcaccagccatcattactcccatattttgtaagacaatgggaactggaattaacaagagcggaattctaggcatcagccccatcacaatcgttaaagctgttatcattgctgctaaagtcatcatttttactgcactttggttgcttctctccatttttaaaacctaccttctttaattttgaaacaaattcattatatataatagtaacctatttttatataacaaggttactattacagattttttaatcggttaatttcaaaatttttaggtctaaaccgtgttggagattactttttactcataattttggtgtgagctattcctttcttcattctttgacaaaatcttttcaattgtcacttctaaaattaatgatctatccgttgtacaaaaaaacgaattaaagcagcattcaaactactctaattcggtttcggtttttaatttattaaattacatttcgttcaaaaggttggtcactgataccgtcatccaaaatctttttcgcccattctttagctgaaaatagtgaatgatcacggtaattaccacaactgtagatgtccgtacctggtacatcttcccacttagtaacatttgcgatttcttctagtgcacccttcaatgctttagcaacttctgtggttgtaggttctccccaagcaatcaaatggaaacctgttcgacatccgaatggagaacagtcgataattccatccattcgatctcgcaataatccagctagcaaatgttcaatcgtatgtagtcctgcagtgggaatcgcattttcgtttggttgaactaaacgtaaatcgaaattagaaatcttatcgcccttattccccgtttcaactgtaattaaacgtacgtacggagcctttacctttgtgtgatccaattcaaagctttctacttttgccataaaaacatccccctattcatcggtatctatgtcctattttagaacaactcgatcctgatataaattaaaaaattcatttaaaaatcgtcctggctaatgttatgcatcaaatgataactgaccatcattttttgcaaaggacggagattaacaacggggaggtaactaggcattctaacccgattaaattcacgtccagttacatcttgatagatagaatataataacaaaatacatacaaaaattagcggaaatcctgcaaccgtacagattgcttgaacgacctcaaatccacctactataacaattcctaacgagaaaataataaacacgatgacccaagccattcgattccatcggctaggttggcgaccatgcgacaagtctagactggtgaatgatgaaacaataaatgcggaagaagaaatcgtcgttgctaagaagataaaacatgaaacacagaaaagaattagcatcaatttattcatcggcaaagttgtaatcaatgctgcttgaactgctgcttgtccttgtgtattcaaaatgtgcacgatgtttaaagtgcctgattgttgaagccatagagcatagccccctaaaactgcataaaatgaaatacagccaccgactccataagtcatcatccctaaaacaacttggcgaatcgtcttaccatgcgagatccgggcaataaataaccccattaccggcatgtaggctaaccaccaaccccaataaaacagggtttgatgttgagcaaaaccattggtgccagcattagctttattaaaggaaagcgcagtaaaatgttgcgccattaatttcaaggtttgaccttctgagcccactaaaaatttagttggaccagctactaaaacaattgctaagaaaataattgccaaataaatgtgccatgctgatagttttttaattcccttatttaaacctgcgtacacggttaacgtaaataaaatcaataaaataaagaataaaaatagttttaaataaatcgtatctttaatacctacgataatacttaaaacacgtgcaatcacgggaatttccattccaatcgaagaaccaattccgcccatgatcccaaaaacgactaagaaatcaattagttgacgtaaaacttttttgtataattgatcgcccttcaagaggggaattacagtacttaatcgcattactggaattttttttacatacattgtataagcaatagcaatggtggcagttgcaaacatcatccatgccatcggcccccaattaaactcgcccactacgttagcataggcaaacgcttgggtcgataatggcttcgcgccaaatgccgggtgctgaaggtattgcaatggatcagttgcacttaacatcaaaatacttgcatcaattgcagttgcaaaaaccatgcttccccattgaaaaccactatagtctttagctggatcagcctttccgaatctgattttaccgtatttactaaaaatcaaaacgataaaaaacatgaaattgatgacataaattgagatatacaaccactcgtatttgcttgtaacgaatgacaacaacgcgttcattaattgctgaacggctgggccgcctgtgatgaggatgattgatacaaccccaaataacaccattgttggtaaaaagacagctcgatcgacattcttactgtgtaagataaaaaattcctcccatattttcaaaaaattggtacaaaaaaagcaacaccattggcgtattaagttcacacctgcatagcgttgctcgatcggattgctccgaaattcgtcatacctgttactttcatgttactactattaatttaaatatcaaattaggctagatttgtttgattactctggcaggatttcccgcaattaccacattgtccccaaaactctttgttaccactgatccagcacccacgacgacgttattgcccaaagttaccccaggtaaaacggtcactcgtcctccaaaccaacagctattaccaattgtaattggagcacctaattctacatcagcatttctcttaacgggatcaagtggatgaataggagtatacagccccacgttaggaccaaaataacagtgttcaccaatcgtaattggacacgtatcaaggaaagtcatatcgtagttgccataaaaatgattaccaatgtgaatattccatccataatcaaatttgaattcactctcgacaaagaaatcgtcatctacatcacctagtagttttttaaagccaccattacgtttctcattgtctgtttcgttgttaatcacttgtaattgttgacggatgaactttcgacgaccaattaattcagcatcaaactgctggtaaggttctccagcagtcattttttctcgttcagttcttgtcatatttacgcgcttccttctttaaattagcccttcttgttgcaaccctgcctgcgctaccaagttaataaaattaaatggtcgatcgtagtatggttggaataacatatccacaaatgctaaatctttcagcgtattttgattctgaattgctaaagacattgtattagccaattgagaaacattatgttcactaaagaattgggcccccagaacttttaaactgtcctgttcataaacaattatactgtttattttttccgttgtcggcataaattctggacgataattgtcctcatagctgatatatttgacctttaaaccagcatctaaagctcgttgataggttaaaccggtagtagctaatgtataaccaaacaattgtaagcctgatgttccttgcgaacctatttcaggccaacgattaccgaaaatattaataccaactaatttaccttggcgaattgcattcgtcgccaatgggatatagctatctgtatccgtcggattgtaatgtacagtacgagcatctcctgccgcgtaaatatccggatcagaagtttgtccatattcgttagttaaaattgcaccattacgactcattttaacctgcccctctaacaaattagttaccgggatgaagccttttgaaacaatcgctacgtcaacttcttcattttgatcatgaatggtagtaaccagtaaggagtccttttgatccgtgaatgatgcgactttactattaagtttaactttgaccccgtgatcttccaggatttcaactaacattttgctcagctgtacatccacgtaattatttaaaatcacatcatgactatggtataaggttacttgacaacctaaatcagacaagctttctgctaactctgcgttaacatatcccccaccaattaatgcaactcgctggtggggttttaaaacttggtgtaaagtctgcgcttgttcatagtttttacatagcattactcgtttatgattaatgcctttaattggaggtaaggtcactgctgaacccgtgcacatcactaatttatcgtaatgttcacgacgaatactatagtcttccatgttttgtaccaaaatctctttttgatttcggtcaatttttagaacatcatgtcgcaggttcacccgaattttttctgaacggagatcctctgcatcatcatacatcatgtcttctagccgttttacgcgaccattcagatacaatgcgattccacatgataagaaagagatattattattacgttcataaatatctacctccgtatccggattttgtcgtaagatttctctcactgctgctgtaccagcatgggtacacccgatgattgctactttcattttgcctcctacttgttttatactggacttacttgttaagaattttttacacgattccagatgctttatattttaattttagactggattaagactttgtaaatgctttaataaggaaaattagcaaactaaccacgccaaatttcaaggagtttacttaatgcttagattttttatccaaccgcagttaaatacgattgttgattcagtaattggttacgagatgctgatcaaagaataccgcgatgggacctggcgaatgcctgcttctttttcagcaattccagcccatgatatggcagaattactgattgcaactgctaaagaattatctcttaaagttggttcagtttcatttaatgttgatcgtaaccaaattcttgatgatcaactaattcacgctttaattgccgcccagacagttttacgtccagttaaattaattatcgaattaattgaaaatgatgttaaaccctcggtgtctgatgagcaattaattgaagttgttacgcaattgaatgactttggaatccaattttgtctcgatgacgttggtagcggaattaatacatggcctgcagttaagcctctactaccatacactcgtgaacttaaatacgctctccaaaattataaagagcatttggatgaatccgccgctgaaaatcacgttaccttttggcaaaacctagcaactaaacatcaaatgcgtttcattttggaaggtatcgaagatgataatgatgatgcttgggccgattctatgaatatcgatttacgccaaggatactactatggccgccctacactaatgaaaatacatcccgatgatcccgattaacttatgtaaagaaaaaccgcgttgcgagacacaatcgtaacacggttttttatttagtttctattcgatttcaattccggaagtcttttcaccactggccttaggtaaggtaattgataaaactccattatcaactttagccttaatatcttcagccttaactcttggtaattcgtaacttctccgcatgataccatagcttcgttcggtcatcgtaacattatgcttttcatcttcatgatcagcaaaactatctttcttcacttccacatttagcacgccatcttgataatccaatttaatatcttttttatcaattcctggcacatcgattttaactttgtaatcagtatctgattcactcacgtcggtcttcaatgtttttgaggttccatcccagccgttgttgaaaaatccgcgcgataaacggtcaaaaaatggatcccacatatcattcctacgattcatcatttcattagccataaaaacaaaacccctttctaaatgattggtgaagttcttcgcttcatccttacacctataatgttagtcacattatagtattatgtcaattactttactcaagaaaatgttttcaataaaaaagacttacccaagaacaagatattgtccattgcataagtctttatctataattgtagatttagttttcagtattgattctttctgggaaccaaatcttaatttctttttcagcgctttctacactatctgaactatgaactacattcttaataggaccaggcccccatgctctggcaaagtcaccgcgaatcgttccggacattgcttcactcggattagttggaccagccattttacggaaggtgtcgataatttcattgccttcagcaataatggccacaattggaccacttgtcataaatttttcaatgtcggcgtaatatggtttatctactaattgtgagtaatgttgacgtaactgttcttccgttgcgtttaccatctttaaggctttgatttcataacgacgattttcaattcgtgaaatcacatgaccgatatgtccacattgaactccgtctggtttaactaaaattagtgatttttctgtactcattggcaaatcccccattggttttatatgccaattatatactagagaacgcctagtttacacgtaatatggaatgtaagccttttactaaaaaaatttttacttaatctttaacgccaacgcgttcaatgccacaataacggttgaaagtgacattaacaccgctccaactgccggactaaggacgaatccaatcggagccaaaattccagctgctagtggaattgcaaacaagttatatccagctccccaccagaggttttgaaccattttagcattggttgcttgagctaatttcaagaagttcaagatatcacttggatcactgtgcacaaggactacatcagcggaatcaattgcgacgtccgttccggctccaatggcaattccaatgtttgctttagcaaggctaggcgcatcgttgatgccgtcccctaccataattacttttccttgctcttgatatttttcaagtgcctttagtttgtcttctggtaataattctccatgccattcatcaatttgaaggcttgccgcaattttttgcgctgtttgttggttatctcccgtcaacattaccggaatataacccaattgctttagttctttaataaaggaaactgcattttcctttatttggtcgccttcagctaatccacctaaaacttgattttctcttactaggaatgaaactgaattaccagctgtgctccatttctcaaaatcatttgtatcaaacttaatctctttttgtttcaaataaggggcgttcacaatctgatacttctgaccttcgattgtacctgttaaaccaatccctttttgagctgaaacatcatgagctgttttaattgtttgcttcagctttttagctgctgctttaataccagttgctaaaggatgatcggaatggtcttctaagctagccatcagtgctagaatatcatcttggtttaaatcgtcagcataactcttaactgcgttaaccgtgaatttaccttctgttaatgtaccagttttatccatcaggacgtatttaacttttttagcttcttcaatcgattgacggttacgaactagtaaaccattggtggccgcaatactggtacttcgtgcaactactaatggaattgctagacctaaagcatgcggacaagcaataataaagaccgtcaccattcgttcaaatgccacatccaagccttgtggtaaccaagccacaaacgcaatcacaccaacaattagagccgcatagaataaccatgaagctactttatcagccaaactttcagctttggatttagatttttgagcgtcactaactaacttcattacttgtgatagatagccactttcgccagttccagtaaccttaacttcgataactccgtctccgttaactgctccaccaattacttgactaccttcttttttatcgattaaacgtgcttcaccagttactaaagattcatttactttagttgaacctgaaactacgtcaccatcagttggaatttgttctcctgcaagtacgcggaccgtttggccaacttcaacatcgctcaaatccatatccatgacatgatctccatgtaaaacatgcgcttgactaggtaaaagtgcggccattttttcaactgcagagcctgcggccatcactgaattcatttctacccagtgccctagaagcataattacaattagtgttgcaagttcccaaaagaagtccattacatgaccgctaggattaatccattgattcattataaatgcataaagcgaatagccatatgctacggtaattcccatcgcaattaaagtcatcattgcgggtgcttttgattttaactcactgactgccccagtcaaaaaaggcttacccccatagaagaataagaaggttgctaagattaagacaatataatcagaaccggtaaaactaatcggcaatttcaagtcgccaattctaaaatccattcccataaatggcgataataatagaattggaatagtagcaattaagcttacccaaaataattgttttagattccccatgtgcatcatatgtccatcgcccatgccatgcatatcgtgcatgtcatgttgatatccactcatctcatgatgcatctgggaatgatccatttttgaatggtccatgtgctcttcattcatttgcttatgattcatgttacatatcctccatcttacaatccatatcacagtcttctggcaaacaattacagctcaccttatccggtgctgtttgtgccttttcctccaacttaccaattaacatttgaatgtcacttttagataattcaatttgatcaattaaattagctaaagtagttcctaccttatgttggcaaagatggacaaaaagggatttagaagcattatccattgcaacttgttcttcaatcatgggctgataaataaattctcgtccatttttactggttcttaaagcccctttttttactaaccgccctaaataagttttagtggtggaagctttccatcccaacttctcttccaaaatttcgataatttgatgactcgtagccttttggagcgtccatattactcgcattgtttcccattctgattgactaatttcaatttcatcactggtattcaaactatatcctccaatctgtttacaaatgtaatctttaaatatagactacatttgtaaacttaaaaagtcaagaaaaaagacctcgatttccatcgggtcttaattaattaagatgaagttttaattttattctagattagttcttgagcgttgaatgataataatagctatgataactaatactgcaccgattaattctacgacgttaaaaggatggcctaggaatagtaaactcaacacaaaagtcacgaccggctggacagcatccaaaatacttacaacggcagatggggcaaatttcaaactgtgtaataaagcccagaaaggtaaaatagttcccactagaattaccgttgccattgaaagcattaactgtggtgtcagagctggtgtatttacccaaactggttgatgaatattaaataatatactaccgataattagtgcccatcctaaaacaatcattggcggatggtttttagttactggtttaggaagtacaacataaaatgcagctgtaattcctgaaagaattccccaaatcaatgctttattagaaatagctagttcatggatgtttccatgtgttattgccaagaaaacacctgccattgcgattacgaaagcaatcacatcgcttcgcatcgggcgaacacgctgaaatactaagctccccaaaacaataaataaggggcttaaatactgaagaatggttgatgctgacgcattaccttcttgaacactaatatagaaagttaataaattagccattaaaccaaaaatagcatacgctaacaaccataaaacggttttaactgatttaaaaacatcaaaaatttgcatccgatacttaataaaactgataacaattaatactaaaccagcacctaatgttctagcagataaaaaccaggaagctggaatactctctccttgagaaataacttccaataccgttccagaaattccccacatacaagacgctaaaagggcccaaaaaattcctttaccaatatgcttgttcaaaacttctttttccatcaaaaacctcacatacatttttctaatatatttaagtatacctaaaaagttataggctataaagtatattcgtgtcacatttcctaacaccgtgtatttttttgctaatataaaaaaacaggagtaatctcctgcttttattacattttgataattattcagttgttcccttaataatttcaaggattgagttaatgtgttctagagttttaacaaagtcgtcttttccgaatttgctagcaaccacatcaagcatttctctaaaaatacggtcattttcctcatataaatcgattcctttttgagttaatttgaggtatttttttcgacgatcttgtttatcattattttgttcgactaggccaaggtccaataaagttccaatttttcttgaaatggcactcttggtaacctcttgcgcatcagcgattgagctcaatgtaattgcttcaccatcagcttgcttaataaaatgcataatcatgaacatatcgaaagatacttgtggatctgacattttactttctaaaagcgtaccgattagttttatacttttgttatacgtttgagcaataaacgtaatatcagcttgtttcattttcttcctcccgattctagctttcccagccgtttacatagttaaatattaacagactcacagaacttgtcaacgcaaatattaattattgatgacatatcgtgttcttttgttcacttacttttaatgaatgaccctttaaaacgagtaattgttctactaatacttattttaaaacaattgtgaaggtaatatcaaattcatattaaaacgttttaacccttcatactaagaaactatgatactttacccatatcatagcttctgataatcctaatataatttacttacttgttcttggatagcatcatgatttaaaaactcatcataagttgtttcagcacgatcaaccgaacctttatcagaaacttcgataatatgatccgcaattgtttgaataaactcatgatcatgggaggtcatgataatagaactcttgtaactagtcaatccctcatttaatgcggtaattgattccaaatctaaatgattggtagggtcatctaggattaaaacattagccttgctcaacattgtttttgaaatcatgcagcggactttttctccaccagagagtttagtaacattttttagtacatcttcccctgagaaaagcatcttacctagaaaaccgcggagaaaagtattatcactttcttctttaggtgcatattggcgtagccattccaaaatatcaaaacgatcgtcttcaaaataactgttaatatcacgcggaatataactacgttcagtagtttgtccccaagttactgaaccgctatctggttccatttctccagctagaatctgcatcaagactgttgtagctaagtcattttgactcaaaattgcggccttctcaccagggcgaacggtgaaagtaatattatctagaattttcacaccatcaattgacttgctaaccttgtccacccgaacaagatcattacctaattcgcgggctggttcaaaacgaataaaaggatatttacgtgaagaaggtttgatatcgtctaaagtaatcttatctaattgcttcttacgggaagtggcttgtttagattttgaagcattagcactaaaacgagcaacgaattcttgtaattctttgatttgttcttcttttttagcattagcattttcacgaagacgtttggctaaagcactagattccatccagaaatcatagttaccaacgaaaagttcaatcttaccaaagtcgacatcacacatcatcgtacaaaccgagtttaagaagtgacggtcatgggatacaacgattacggtatttggaaagtcagctaagaaatcttctaaccaactaattgattttggatcaagtccgttagtaggttcatctaaaatcaaaatgtctggtttcccaaacaaagcttgtcccaaaagcactttaattcgttgaccttcggttaattcgctcatcttactgtcatgcagactttcgtcaatgcctagctgttgaagtaattgtgatgcttctgcttcagcattccaaccatccatttcagcaaattcagcctctaagttagcagctttcatcccatcttcttcagtaaaatccgctttagcatataaagcatccttagcttgcattacttcgtataactttttataaccttgaattacagtattcattacggtaaattcttcaaaagcataatggtcctgatttaaactcgacatccgttcattaggcgaaatactaacgttaccagaagttggttgaagtttaccttctaatatttttaaaaatgttgatttaccagcaccattagctccaataattccgtaacagttgccgggagtgaattttaaattaacatcgctatacaattttcggtcagagaattgcatgctcatatcatttacagttatcatttagttcctccattttgtagacaaaagaaaaagaggcaaaacaatgtcttgtcccaatttctaccagtctgtttaatttaacatacctactatccttgaacaaccttattgtttaggatatttaattaaaatggcttttatattttattaacacacaattttttagtccctctgcattaaagacaaagggctcactttaaccatttgtatgtcacccattagccataaaaacttttatttttttagctctattctgctgacaaagcttcgactggatccaattttgaggccttacgggatggcgtaaaggccgccaatagactaatgatgacactaatcactaccccaaaaatcagataacctggtgcgattccaataatcgcaaagtcgatatgcttcatagagattacgttagctccccattgagctagcaatgcaaaagctgaacctaaaatacttgagaaaagccccaagaagaatgcttctgaaacaaagaggttacgtatatcctttcgacgcgcaccaatcgcccgaagaatcccaatttccttagttcgttcagaaacgctgatataaagtaccacaataatcataattgctgataccaatagcgagattcccgcaattccagctaacacatagaaggctaacatgatgtaagtattcaatgaatccagaattgcgcctaccccagtaattgtgtattgggggcgttctttacccttaacatcatgcttgtagttcttaattttattttgaacgctcttaacattctgagtgttattgacgttgactgtaaagaagttgggctggtaatccaagttcttatctttaaacatttctttcaacgtattatagtcaatcgcactcgttcccgaggtaattacccctgaaactgtaacttctttttggagttgaaccggttgttttttactatccacggtcgttacgaaaactgtaattttcttacccacaacgtttttatactttttatcaaattttttagctgtagccttatctaacaggatttctccattaccaggcttgctaccatatttgatatcgccttcacgttcggtcttattccatgtctgtaaaacttgcaaactaattgattttttaccagcgaccgtctttgcagattgaacatagtagccgcgttctactgatttaacattctttatcttattcattcgttggtaatctgtgtttgatagatctgcggtttcaccgttttccatttgttcttgggttacatttttagcaacttgaacagccgttggattgatttgtgatgaaatttggtcattcatataacccgtaactccatttcccaaacctaacattaaaataaccgagaaaatcccaatggatgccccaaaaatgattaacaggtttcgtttgagattgtagctcatatgtttcaaagccattcgtaacgaagcccggaacgtcaaatgtttagggaccaacgttttttcagcgtcagggactggataagccgcccttaaatcagcctcaccatgaatcactccgtcatccaaatggaccactcgtgtaccaaaatcggctacttcttgcgaatgcgttacagcaataactagttttccatctttagcaatagattccaaaatttccaagacttctttagtattttgactatctaaagctcccgtaggttcatcagcaatgattacatcagggtctccagctaaggctcgcgcaattgccacccgttgtttttggccacccgagagttgattaggatgctttcgcatatgttctttcaagcctactcgttctagtaatgctttagcccgttctactcgtttagcatgagaaagtttcgtcatttccagagaaaccattacattatccaaaatgttcagatgactaatcaaattaaaactttggaagatgaatccgatattttctcttcgataagcatctaacaccttaggtttagccgagcgtaatgattgtccattatagacaatatcaccttcgtactggtgatctaatccaccaatgatattcatcagggttgatttaccaccaccggattcacctaaaattgaaacgaactcgcctcgatcaaattgcagattgattccttttaatactttaaattcttggttacctagaaaataggatttatgaacatcccgaacctctaataaactcatactttcctcctatatggtccttcagtgattatttggagtgaacttgttggaaatgtgttgggtagaaatatttctctacttccgtcacaatcaaaacaatgattccggctatcactggaattaaccattgtgcccatcccatggaagcagtgccaaagattgactgcatgaatggtacgtatgttaaagcaaattgtaacaccaataataccgcaattatccaaaaagcgtgtaagtttctcaaaatatctttggagaacgctggcttaggagtccgtagattaaatagatagaaaatcttaccaaatacaatggtattaaccgtcaccgtacttgccactacttcactaactccatggtcaattaaccaatcgtaaccaaaaattcctaatccggcgattaagatggaaacataaacaatttgaattacatcggctcgatttaagaaggatctgcctgctggacgtggatttctatccataatgccctcttcggcaggctcgaatagaaatgcaaattggattgtaatggcggataccatgttaatccacaataattgggttgggactaatggtagatcttgttgcgctaggatagaaagtagaacaatcaacccttctgcaaaactggttggtaacaagaaacgaatcgtctttttaatattatcgtatactcgacgaccttctttgattgccttagttaaggttgcaaagttatcatccgttagcaccatgtcagccgattctttggcaacgtctgtccccttcgttcccattgctatcccaatgtcagctcgttttaaagctggagcgtcatttacaccatccccggtcatcgccgtcactaaattattagcttggtaagcttttacgattcgtaacttatcattaggggtggttctcgcaaagacgttgtagtcttgaatgatattttttaactgttcatcatccatctcgttgatttcagcaccagtaattgcagcaatctggtcatccaagcccagtttttcagcaatcgcggaggccgtctcaggatgatcaccagtaatcatttttaccttaactcccgccttttgcatctcatgtaacgctacaatcgtttcttcacgtggcggatcaatcaatcccgcaattcctaagaactgcattccactctgtaaatcttcatgtacaatcgtttctttattatcttcaacttccttataggctactgcaactactcggtgccccttttgagctacttcagaaactttgttgtaccaatattgttcatcaaaggtagcatcatcgattgcggccattctaaaaatcttatctggcgaaccttttactaaaattcttcgctgcccttcaggactctgacttagttcagcaatgtaacggtaatcggagtcaaatggaattttatcgatctcttcccattgcggtacctgctgatgaaacgctttgttagccagggttaggaatgcaccatcagttggttctccgttaattacccaagtaccattttccttagacaagattgtgtcgttagcttcatgcccagcaataattagctttcgtaaatcttcatgctgatgaacatcaataacttggttattaaaccgaatttcaccatgtggttgataaccggtccccgtaatttcataggttccttgcttggtaatgatttcttcaatcgtcatttcgttcttagtaagcgttccggttttatcagtagcgataacattaaccgctcctaaggtttccacagatggaagagacttcatgatggcattttgttttgtcatcttccctactcccatcgctaaaacaaccgatgtactagccggaagtccttccggtaaagaaccgacaatcatggtaattaaggcgattactaaaaccggtaacgaataaattttagtaacaaacccgtaaataccgactaagatcgctactacgataatcgcgtacgaaatatacttacctagtccattaatctcacgcattagtggagtagttttagagccaacctcttccacactcgaactaatctgtcctaattcggtatcggttgcggtcgctactacgatacccaatccactaccattggtcacggccgttgacgtaaatgccatgttagtctggtcacctagggtcgttttttctggcaatttgtctgtattctttaaaactgagtcagcttctccagttaaaattgattcctgaatttttaaattatcagcgtcgataattcgcaaatcagcgggaacattgtcgccggcttctaggaaaacaacatctccaaccactaaattttcagcaggaatgtctgttctgtgtccatcccgaataacagtcgcttcaatttgaagcatctgtttaattttgtcaattgcacttgaggcttttacctcttggaaatacccaattagggcattaataattaccaccattccaataacaatcgaatctgaatattctttcaaaacaaaggtggcaaccgcagctaaaatcaaaatatagataatactattattaaattgctttagaaaccggattaaattactttgctttttctcgatcaacgcgttgggcccgtactttttaagtcgttcccctgcttctttttcggttaaaccgagttcagaattagtccccaaatcttgggcaaccttttcaaactcaatattataaaaattatcattgcgcgactgcgctccatagtcatcggatgtggattttactttcatcgatattctccttttaaaataaatttttgggttaactaaatcatatctaaaatgaataatacgcgtcaactaacttatctttttaataagaaataagtcttaaaaagaaccatttaatactttgcagtggcttgctgcaaaatttatttttcaaaaaaagccatgactttcaggccatgactttcaattttagttttaaattgtgcgttttctcatttttttctctaatgcccctaggactagatctgagataatcgccatcaacgcggttggtaatgccccggctaggataattgctccaccatttgtggcattagttccacgaataatgatatctcctaaacctccagctccaacgaacgttccgattgcggtaattccaattgccaagacaagtgcatttcgaattccggccagaatcaccgatagcgatagtggcagttcaatcatccaaagcacttgaaccttggtcattcccattcctttaccagcatctaagtaagcttcgtttacgttcaacattccggtataagtattcttaataatgggcaataatgcgtataagaataccgttacaattacagttgtaactcctaaaccaagacccaacattaaaatcgagagcattgctaaagatgggatggtttgaataacattagccagatcaacaatccagccactcaatttacgatgtttagaaataagaattccaattgggattcctacgatcgcagctaaaatcaccccataaattgaaattaaaaagtgacggctaaattcggaaagaacgtacatgccattatgagagaagtaataggctaattgttgccaaatattcatactttgcattagttattccctccttcaaaatagtggttcttttctaaaaattctttagcaaccactgacggttccttcaaattattatcaacttgatagtttaattcttgcatggtctgcaatgaaatttttccatctaatttatgaagaacccgtttcaattccggatatttcttcaatgatttattattcacaaccacacttgcattgtatggtggaaagtaatttttatcatctttcaacaattttaaattgtagctacggattcttccgtctgttgagtaacccagaaccgcatccattttatgactagcaagagcattataaactaacccaatttgcatgggataaatattaccaaagctataaccgtaacgttttttaaaatctgcgtatccgtcacccttacgacttagccaagtttggtcaattccgactttcatatctgacgaaattttcttaagatcactaacattttctagatgatgttttttggcataatcttgcgtcaccataaattggaaagtatccgcaaatccgtaggttgggaaataggtcatatcatagcgctgattaaattcttttttaacataggcattcacttgttctggagtgcgcccttggggtccattcaaaatagtctggtaatccgttccactaaaacgaacagctgttaggtcagcttccccacgtttttgagcttgaaaactaaccgttcccgatcccaagttattgataatctctgcattcaagttagtatcatgttcaatcaattgttgaataactgaagacatcacctgttgttcagtagtattttgggcagcaattttaactgtatttccagtcgtaccgccaagtcctggccagccacaaccggaaagaactacagctaatacgcccaacggcaaaattaatttaagaaatctttttaacatttagcccacctcccgtgttcgaggggttaatttgtcttccaattttccaagtaataaatcggcgactaaagctaaaataatcacagggattgatcccgctaagattaaatctggacgatatagatttaaaccgttgaaaatcaagtcacccaaaccgccagcaccgatataagatgccaaagcagtccatgcgattacataagtagctgataaacgaattccagacataattactggtaatgctagttgcaattcaactttccacaatcgttgaaaactattcattcccatccctttagcagcatccactaacgctggatctacactatctaatcccagatacgtgtttcttaaaataggaagtaatgagtatataaataacgccacgatggctggagttgacccaattccaaaaatcggaatcatcattgcaagcaaggctagcgcaggaatagtttgcatcacactggctaaaccaataacaaaaccagagatcttaggtgcccgaattaaaagcatccccaaaggtaccgccacaattatccccagcgctaaagcaaaagctgaaatataaatatgttgtcccgttttacttaagatgtcgcctccatattgattcaggaagttgatcattattgatcaccatctttctctttttgctcctccgattttgaactagcatcggtactgctgtctgtagtgattccatcatctgtaaataaagcatcataaacaatatcaaccaaggttgctcgggtaacaattccaactagtttacgatcattatcaaccgctggaacgttacgaagtccccgtttcaaaattcggtcaaccgtatcacgaataattgaattttcatttacatagaaaacatttggatccataatttcgcctacagttttaccagaatggtaatactcattaatcttttcaatgcttacaactcccttaagatgttgttctgcatcggttactaataaagtatcaacccgtcgactgtgcataatatcaagggctcgaactacaggttggtcaatcgcaattgaaactggcttattagccacttgcccaacggtcgtaatacttggtttagcttgaatcaaacgatcttgtccaatcaaattagccacgaaatcatttgctggttttcgtaaaatattttctggtgtatcaacttgaacctgcttaccaccagtcataaccactattcgacttgataaacgtagtgcttcgtccatatcatgcgttacgaaaataaatgtcttgcctagacgttcttgaagatctttcactaagtcttgtaaatcttcacgggtgataggatcaagcgcaccaaaaggctcatccatcaaaatgatatcctgatcagctgctagtgcacgaacaaccccgattcgttgttgttgtccaccagaaagctgggaaggatagcgatctaagaagtcctctggtaaatctaccaatttaatcatttctttagcgcgttcgttacgcttttcttcagaccattttaatagtttaggtactaatgttatgttttcacgaattgtcatatgaggcattaacccaatattctgaattacgtaaccaatctttcgccgaagtttaactgggtccattttggcaatatcttgcccattaatcttaatggttccagagctctgcttaagcatccgattgatcattcgcatcgtggttgttttaccagaaccggacgtaccaataaaacagatgaactctcccttttctacatccagattaaagtcgtcaacgaccactttatttccaggataaactttcgaaagatggctcatttcaagtaacatttgtatttaaacatctccttattaaatcttgcaattctctttaaagtgtttaaagaattacaagttgttgaccgcaactataacatacctagaaaaaaaatgcacaaaatccagcttttatccttgacattgtagccgacttctttcctattattaaagcttattaaacttgtgaaaaccaatagatgttgtaagatagtagtataaattaaaaggagctgattaaatggcaaaatatgatacattacttccacgttttcttaaatatgtaaaggtaaacactcgttcaaatccaaattctgaaacagttccaacagatccaaaagaagttgaatttttaaaaactttagctaaagaattagaagaagttggcgttgttgatattcacacacaagaatctggttacgtcgttggtacacttcctgccaatgatggtggtaacacaccagttattggttacatttctcacgttgatacagctgactttaatgctgaaaatatccaaccacaagttcacgaaaattatgatggtaaatctgacattgaccttagtggtgatggcgaatgggtacttagtcctactgttttcccaagcttaaacaaatatgaaggtcatgatttagtgacaactaacggactcactctactaggggccgatgacaagtctggggtggccgacattatgactatgttggactactacaaggctcatcctgaagtaaaacatggtgaaatccggattggttttgctcctgatgaagaaactggtactggggccgaccattttgatgcaaaagattttaatactaaatatgcttataccgtagatggtggtccacttggcgaacttgaatacgaaacattcaatgctgctcaagctacaattgaaattcaaggtaacgaagttcatacagccgttgctaagggattgatggttaatgcactccaagttggtattgattatcacaacatgcttcctgaacatgatcgtccagaagaaactgaaggacgcgaaggcttctatcatctatttaagatgacgggaactcctgatcatgcacaattggtttacattattcgtgatcatgatcgtaagatctttgaagaacgtaaacaaaagatgcaagaaatcggtgacaagttaaatgaacaattcggtcaagaacgggtaaaagttgaagttcacgaccaatactacaacatgcgtgaagttcttgaaaaagatatgacaccagttgaaattgcacaaaaggctatggaaaaccttgatatcaagccagatatctatcctgtacgtggtggtacagatggttcaaagatttcatttatgggcattccaactcctaacctctttgctggtggcgaaaacatgcatagtcgttacgaatacgtttctgttcaaactatggaacgtgccgttgatctcttgcttgaaattaaccgtctaaactcagaagaaaataactaattttttaaggactgtgacaacctagttgtgcagcccttttttaataaaaaggagcttacttatggcacttacaatggctataatcggatttggcaaaagcgctaatcgctatcacattccgtatattaaagaacgcgatattaaaattaaatatatctataatcaccgtcgtcatcccgaaaaagaacaaggcttttatgacgctgacacgattttcactgataagcttgaccaagttctagatgattctgaagttcaattaattaccatttgtaccccacccgcaactcattttgaatatggtaagttggttttggaacatggtaaaaacgttctgattgaaaagccttttgtagctaatcaagacgaagctaaagaactctttgcattagcccagtctaaaaaattgctagcaatgccttaccaaaatcgtcgttttgatagtgactatttgactctcaaaaaagtcattgaacttgggtacgttggtaaacctttgtcactcgaatcacattttgacaaatatcgtcctgatgaccgcctccatgaagggtatcaggttgatggccaattttatggtctaggggtccacatgctggaccaaattttaggactctttgggaaacctcaaactgttagctacgatattcgagctatccaaaattcagctagtacagtagacgatttttacgaaactcaattgttctatgataactttaaagcaacggtcgttagcaaccccctagcagcgcgtccctatccgcgtttcttattacatgggactaacggaacgtatgttaaatacgatattgatcaacaagaaaacgacttaaaattaggcattatgcctggagatcctaatttcggcattgatactccgagtcaatttggcgtggttaaatataaaaaccaaaatggggattggattgagaaacaaatccctactataaatggtgattatggtcgggtctacgactccatcgctaaaacgttaactaatcgggatgcaaaactcgtttctgataagcaggccctttggaatatggaaattctagaagccggtatcgctgaaaaagggcctcatctttataatttgaaataaaaaaaaccattaaacgataaatgtttcgtttaatggtttttactttacattatttccaacgtaaatttttcatcgcagcgctttacccggctgctaccttaaattgttcattaacatatttagcatacatttggtgtgaatcaaccaattcttgatgggttcctgagccagtaatttgaccattttctacaaaataaatttgatcactatccacaattgtggataaacgatgtgcaattactaatgttgttcggcctttcattaggtttgccaacgcgtcttgaactttcatttcggactctgaatctaaactagctgttgcttcatctagcattaaaattttaggattacgtaggaacgctctagcaattgcaattctctgtcgttgccctcctgaaattttaacacctcgttctcccacctctgtatccaattgtttaggcatttcttccacaaatttcttagcaaaagctaattcaagtaccttccataattggctatcttcaaaggtatcgtctaacccataagtcaaattatctcgaatagtacctgccatcatcgctgaatcttgtgacacaaacccaatttgttggcgataattagtcagctggatatcttgaatgttggtatcatcaaatttaatttcaccatgagtaggttcatagaaacgttctaacaaactaaatatcgttgatttaccaccgcccgaaggtccggcaaaggcaattacttgattaggtttagcttcaaacgaaatatcttttaacaccgtttcttctggcgtatcagcgtacgcaaaatcgacatgttcaacttttaaattcttatcagctaaatccaaagtttctccgcggttaaaatcttctggttcttcttcaagcaactcttcaactcgtctagtagaaccggaagccttcgccatttctgaaaataacgtcgcaataatgggcatcgcaccaatcaaattaaataggtacatcagaaaactcatcaaagtaccgatttccattgccccaatcgcaatccgatgaattccatatgctaacaggccaaaaatcatactcatgaaaaccatcatcataattggttgcattgctgcatcaaaaatagcttctttctttccaattttaaataaacgatttatttcattatcagcatgttcttgagcttgattttcggcattcgaagtctttactaatctaatttcacttagtgtttcactaacaattccattaaataatgctagagcatcttgtcgaatatgaccaactttagtaccgaaagccatgactggaaccattaaaattactactacagggacggcaattaccatggctaaagtcatgtgccaatccatccgaatcatcatataaatggtcccaactacggtaataatgctagcaagagtttgaggaaaagttactgctagcagttgcttaacttgattagtatcgttgacgagccgacttgaaatttccccagccttgacggtatcaaaataactaacttttaaaagagtcaatcttttccacaacgttttacgaagattttggataacattctccccaaaaattcccaacacagtgccgccaatcgctgaaaaaatagccgatgcaacaaaaagtaaaactacttttcctagcaatgcataatctacacccttggaaaaattattaactaaggttgaagctaattttggaacgtatacttggactcccgagctaatagctaagaggaatactcctaaaaataaaaggacgtacttaggactagttcgcttaattaatccaaaaaattgtttaaaattaaatttagtatgatccttgcgaatcgtatcattgaagcgtgcattagttgccaattttaacgccgtcctttcttccaaccctcaaaaccaccgaaaccgttaaaatcacctggttgcattctaccaaagtgattgtggcgcaacatttgttctcgagctctttcaaaatggggactcatcttgccaaattgtgcccagcgttgatcattatcaaatacttcattaagcttttcactaaattcatcgctaccgatgttattaaccatccgttctaggtattggtctaaatattctagttcactatcagagaaatctttgaataaaacgtcttttaaagtattcccaatcgaaccatgtgttttcaagctttctcgacctttatcggtaattttcacaactgtcacccgtgaatctttaggtgatttttctcgtagaactgtccccgctttttcaagttttttaataatttgagtaacactagaaggcttgatatctaaatattcagaaatgcgtccaggagttacatttgtttctttagccaaaagttttaaggtttccaaagcattatccgttttttcttctacgcggttagcaaaaactaaaaaaggttcgtgactaactttcattaagttatctaaaatttcatctttattcataataatggttcctccattttattaattgatttatttagtttgtttgtcaacaataaaactaaatatttttaatgcaaaaaaaactctcaattctactcggttacaccccgtaaaattgagagctttaattttaaaactatttcatccgaaaaaggcatagttccggattcatttccagttacttaacttttaaatcttttaattgcgcttcgacatcttcaattttagtctcaacttgtaacaatgccgctgccgtataggcactttcaaccagggcggtgtcatacaacttaacttctttatccgtcatttctatcgccatttctaaattcattttggcgcttcctaagtcataaaaggctaatagcttagtcgcagaattatcttcaaatgcttgtataattcgttgcatatcggttcccacgtcaccattttctagcccaccagcaatcgtaactggaacatctttagcgacttgttcgattaaacgtttaacgccttgagcaatttcactaacatgcgaaacaattaccacaccgtattccataactattcctccacttctagtaaggccttcaagaggtaacctgaagacatggcacctggatcaatatgccctactgaacgttcccctacataagaagcgcgccctttggtagcaatcatatctttagtagcttcgacggccttatcgacatcatcagcagtaaaatcagttttttcagcaataggagcccatacatccaccattgttttttctccggtttctgctttcccccgtttcttaattccagctaatgctgctggtaataacgcactaacttcaccgtctccaactttggccatttccataaaagcagtcccatacaaaggaccagaagctccaccaactttactaattaagctcattgcgattgttttaaaaatagctggaacgtccgtaaaatccttatcggcgatagcttccatgactgcattcatcccacgcgccatattgtttccatgatctccgtccccaatgggtgtatccaattcacttagataatcgtggtgagcttgaatttgttcgttaaatttggtcatccatttttttacattttcaacgtctaacatactatttctctccatcctaattaaaattaccaagcaatggtatctgtggcgtaatttaggttttcaacaatttcgtcggataccttaaacaaggttagtgaaattccggccatttcaagcgaagtcattaaactacctaccttggtgaatttaacttccaaacctaaatcagctaatttatttaaaacatcgttcatgaagatatactgctccatgagtggggtagcccccattccattaactaagacagctacttgatcgcccttttcgaatttgaactcttgattcaattttccaaccaattcttctactaaggccttggaaggttgtaacttttcccgccgatagcctggctcaccatgaatacctacaccgtattcaatttcatcttcacccagtgtaaatccaggtttacctacttctggaacagttgcaccacttaaagcgactgcaatcgtcttgatattaggcaaaactttttgggctaattgttctagttcgtctagattggctcctttagctgcggccgcacctaaaactttatgcatgaagatggtccctgcgacgccacggcgtccttgagtataagtactgttttctaccgcaatatcatcatcaacaactatcgatttaactttaatatcttccatttcagccatgtcttgagccatttcaaaattcatgacatctccagaataatttttaattactaagaatacaccggctcccgaatcaactttcttgattgcttcaaagatttgatccggagttggtgacgtaaacacttccccacaaaccgccgcactcaacattccatcgcctacaaacccagcatgagtgggttcgtgaccacttccaccgccactcacaattccaacttgaccttggatattttttaagtcatgacgataaactacacctgtttctggaattctttctaaatattcggggtaacttcttaccaatccttgaaccatttcatcgacaacattctttggatcattaatgatttttttcatgaaaacatttccccctcggtaacttttttcgtacaattaaagcatagtagaaagcgattacaatcacaagaataaagcctaaaaagtttaataaaaataaaattctcgtataatgaattatatgtacaaaccaaggagaacgatcaaatgattttagaacgcagcaatatgtttaataacgaaggtatcaataaagaactcacgcgtgtaattggatctgaacacgttcaagagtttagcaacttagtacgttactatcgactttgtcagtccgccgtaaatgagattggaaccaagcttgaaaacttggatggtgaatatcgaggagaatatgaccataatcccattcatcatatggaacaaagaatgaaaactataacctctctttttaataaggcagagaaaaaacatttagaccgtgatatcgagtctattaaacaaaacatctttgatattggcgggattcgcgttgttactaactatattagcgatgtttacactatccaaaaaaatctgctttctcaaagcgatattacactcattaaaactaaagattacatcaaaaatcctaaacctagtggttatcgcagtgttcatctagtagttagtgtgcccgtatttttgtctactggtccggtaaacactcctgttgaaatacagattcggaccgttggtatggatatgtgggccagtttagagcataagcttcgctataagaccaacgttgctgacgaaaaagtagaacattttgaaaatcagttagtcgaagatgctaatgaaatttttaagattgaatcaaacatgcaaaatatttatcgtgaattatctgacccacgggtgtttaaagatgaaggataaatatcccgtcacgtgtttttatggagtcccaatcaagcttgataattccggtcattacatatttaatactgaaattaaaatccatgtctggcggaatggcaaacacactaaaggaaagtttctgaaactcggtcaattatttttaaccgagaacaatttactagtggcaatcgtgggcgcaactaaattaagctttaaaaatcgccataattttgttcctttagaacgctttactaaggaatttatttcagatgaaatgctggaaatagctatcaaaaaatttaaagaggaggcagtttagtgcatgcaaactttgattatcgtcgcacatccagaacttgcaaggtctaatactcagcccttttttaaagcggctatcgagaatttttcaaatgtaacttggcatcccttagctacagattttaacgtcgaacaagaacaatctttattactccaaaatgatcgcattattctagaatttccgttgtactggtatagcgctcccgcattactgaagcaatggatggacaccgttatgaccactaaatttgccgctggtcatcaatatgctttggaaggtaaagaactaggaattgtggtttcgactggagacaatgggaatgctttccaagctggggcagccgaaaaattcaccatatcagaattaatgcgtccttttgaagcatttgccaacaaaactaagatgatgtatctcccaatattggccgtccaccagtttttatacctagaacctgatgcccaacaacgcttgttggttgcttaccagcaatacactacgaacgttggtggaggtcactttaaagaccaggccgcttggtttgaggcagaactacaaaaacggattgatcaacatccatcacattctgagcaacttcaacagattttattcactattaaagagcgtcaggatgaactcgacgatttacaatggaatttgattgaaatgaaaaaagaggaggatgtgtgatggatgatcaaaaatggttaattgaacaaattgaacagctccgtcaatctgcttcagactatcgagaacagtccttttatctaggattaaaagactttgttcgggaacaatcgaaaagaatcgaccaaactcaaagagaattagacggaagaatgtgggaatgatttcactaagacaaatatatcccagcaattcttaataattaggcatcaaaaaagaccatgacattgttaattgtcatggtcttttaaggtttagtgttttttatcctcatgtttcttgtcgtcctttgtgcgatctgcccactcttcgcgagttaacacatctttgacgttgagtttaatctcagcgacttccatgttggtcatctcgttcactgccgcagtgatttttgttaccattttatcgaaaatggattgtgcattcttaccatattctagtaaagcatccatcttcaatgaaactttttgattttcgtcgtcgatatctacattaacaccagttgtaggatcatcgcctttagaaattcgatcagtcactttttcaaaaatattaccttctaatgaaagtaccccatcaacgttgcttgctgtttttccagcaattttagctaatacttcatcatcaaatgttagttttgtttctggttgtgctactttatccatagttatagatctcccttcaaaattttcgaagcttatttagcttctggcttaggttctaaatcagaatttggtttgcggttattttgttctttccactgttttttacttaaaacattgtttacgtgaaaatcgagctccacaaccttcaaaccagttagacgttccacttcttcgctaactacatcacaaacttgagtgaaaatttcacgaatatcatagccatactcaacagttgcattcatctcaagtgccacctgcttttccccaacttcagcagtgattccttgagttggatctactttacttcttaacttatctgtcaaactatcaaatagtccgccgtcaaaggaaagaattccgtcaacttttctcgaagctagacccgcaattttttcgataaccccttcatcaaaggttaagcttgcttgtgcaattctaggattgtccatggtttagcacctcctgaatcttacgacgatttttccatgcaaaccataaacttgaaacaaccatcattccaagtaatgattttaaaggtttattacgatccactttctttgccattaaacgtcccccctagttcttcttacgatcaatgttcaaagctgccattagttctgaaattgcctgtgataaaactgacttaccatatctggcacctaggtatccaaggattccaagcactccgaccaacactgcgctgccaaatccgatcgagacccagacaattccgagaatcatcgcaactaaagctcctaacaattcgctactcatctaaaatcccgccttcctatatgactttcagtgacttactggactgcttacgcggaatgatttgaaccttaacatggctcttcattcctaaatgtctttgaatactatcttgaacagtttcttgaatctctttggcattcacatcatagttcccatccgatatatcttccacgcttacttgagcttggatccgatcatttccacggacacgtactttggtttgaatattacccacttgatgattctcagcaattgacttatcaacaatttgttccatcgacttcttaggaatggtcaatttgcctcttccgccttgcaatttcaaatctttctcgctagttcgactagatagtgcaataattaacatgactagtgcaaacagagcgacaataaccccgaatacaattgcaacaacttctgtaaggcggctatttgtggttctcatcgattcaaaaaagtcggtaagataaggaatgaacatttcacttgaaacgaaccaaaccgtttgaatcagggtaattactgccatcaaactcaataaaatcttactggttcgactcatgtaatcacctctatcccttcttacgcattccgaagataacagatacaattacaactaagataactgctccgataattgacggaacgagcgccatacctgctaaggaaggtccccatgttcccaataggctttgtcctaaccaagcaccgacaagtccagcaacaatattgccaatccagccagccggtaaatcacgactagttagtgctcctgcgatggcaccgataataccacctataattaatgaccataaccatccaaacatataaaacaactcctttcagtttatgctgataaccaataaacgctattgcttactggttcaccattaagatatcatgttgttagattgcatatcaaagaatatgcttatcattttcataaaatatacgatttgaggtagcgatttcttttttcaaaatagcaaaaaaagcccacgctatgctgggcttttcggttagaactcgatttaattcactaaaataaattttttcttgaaaaataagctgattttatttaccaaacgatattttacttggttttactagctaatttaacaattccggcagccataattagagctccgcctgccaaattaagtacgccaccgacaatttctaaaaccccactacctttttcgttcttacgcattatctttcctccaattattaaaaaagtgctcgaaatattgtaagcacttactattttaactattttgttttaaacttattatataacttttagaaattaggtgactatagtgataaaaatgattgctacggatatggatcaaaccttccttgacaaccaaaatcaatacaataaacaacgttttagtgaaatttttcaagaaatgcaacgccaaaatattcacttcgtcgccgctagtggttctcaacatgagcgccttcaagcgctgtttgaacctcaagctgagcagatggatttcatctcccaaaatggctccatcatctattccggcaacgaattaatcgatgtgcaacaaatctctccaaggcttcttcaagacacattagattcgattaaccaagcttttggtccagatgagatcttaattaatatttgtggcttaaatagttcatatgtagatacaaatactactccagacgttatgaatttcatcaaaaatttttacaaagaaattcaaactgtcgatgatattaatcattttactaagagcggaattgaagatccgattgtcaaaattgctcttagctttgaagatagtcctaatatcaatcaaaaaattgagcgtttacgaagtcttctagatcctacgttggggagtttaagctcggggttcaatactgaactaatcggtttcagtcacgtagataaatcaactgcacttcagcatttaatgcaaagatataacgtaaacgcagatgaattggtgacttttggtgacaacgaaaatgacttacgaatgttacaaatgactcctaatggatatgctattcaaaatgccttttctaaggtcaaagcagtagctaaccatttaactcgatatgataatgaacatgatggtgtattagacaccctagaaaaactattataaaaaatcggcggtcaattaacttttgagcttaatttcaaaagttttgacaacgccgatttttttagttaaattcacttaaaattgcttggtacgccacaaccgggtcctcagattgagtaattggtctacctaccacaatagctgagcttcctgctttggcagcttccgcaggagtcatcgtccgtttttgatcaccctttgctgctccggcaggtcgaattccaggtgtcacaaacagaaaatcttctggaagttggggttttaaataactaacttcgtttggagaacaaattacaccatctccgccagccgtactagtcaattttgctaggctaagtacttgatctgccattggtaaactaacattctgttcttcacttagttgcttttctgaaatagaagttaattccgttactgctaatagtttaggcgttggtaagtctacttctctagctccaacaaccaatcctcgtttagccgctcgaatcatatcagaaccacccatcgcatggattgttgtgtattgaacccccattcgacctaattgtatcattgctttttctaccgtattaggaatatcgttcaattttaaatcaagaaagatgtcatgccctttttgacgcatatctcgaacgatttcgggacccattccgtagaaaagttccattcccaatttaatggttaacttcaaatgttccggaaattgctccaagaattggttaagttctccccgatccttaaaatctagcgcaatcataactggtttttccataaaaactccattctgaaccgctcttaacatcaaaaaacaccgcaaggtctaggtatgctaaccagcacctagtttgcggtgtattcgttagcttatcaatctctctggatcgatttaaagcgactcgatttatttacattcatgctacttgcctagcctttgaatgtcaaggttctaaaaatggtaaaatggtgttataaattaattaaggagttcaacatgattaagagtgtaattcatgatcaacaaattttatctcaaacgtcaattcccgctaccaaacaagatttatccgtagtaatggatttgatggatactttaaaaaccaatagcgaacgttgcgtgggaatggccgctaacatgattggcgttcataaaagaatcatcgttgtcactatgggaatgatgaacgtccccatgatcaatcctgtcattctcaaaaagggtaatccatataccactgaagaaggctgcctgtcattaacaggtgaacgttccaccactcgttacgacgaaatcgaagttcagtatcttgatttagaatttaaaaaacatacccaaaaatttaaagaattcatcgcccaaattattcaacatgaagttgatcattgtgatgggattattatttagtttcggagaactagcattaatttgctagtttttttaatttatcaccagtttattccaaacaaaaaagcccatccattttagggggcttctccattaaatatcttttagcataattaaatcacgttgcaaatcattacctaattgaaaaacatgttctccaacttggttaaaaccttgagtttggtaaaatttcttagcagcttcgttatgctcccaaacgcctaaccaaattttacgtttgtggttttcttgtgcaaccttaagtgcctgttgcattaatctagaaccaattcccaaacgtttaaattgctgacgcacgtaaatccgctcaacttccaaagtggcgggccccattttttctgactgggcttcatctatgttgacttttaaataccctacaagctgatcagcttgcttagcaaaaaagaagtaggatgcatcattagtaatttctgaagttagctgtttgaaattgtatgctttttgatagtattggtctagatcttcagaactgttatctgcgccaaaagtatcgccaaaagtctcaatacttatcttttgtaacgcttctacttcttcaacttgtactttttgaatatcaattgtcattcaatttacctcaatattttctatgatgaccactttttacatagttccagtcgatactaacgtttcgttcgactttctccaacattgctttcaatgctgtagcttctgcatccgtaaatcctgccagcgccattctactcgaatagctattttcgcgtttaatcgttggatatactgccttaccttgttcagtgggatatagacgtttaatcttatgattgtcccgatcagctccacgtgtaataaatccatccttttccaatttcattacggctcgagctgcggtcgtccgatcaactcgaattttttcagctaattcaccctggataattcctggattttcacatattcgaaccaaatataaatacttgcctttggttaaatttaattctttaaattcaatattagcaatcgaatccaattctcttgaaattgatccaattgatcgtaaaatatcttccataattacttccctctgagagtattttactttaatttagttgcaaatacaacaaaattattttttgattgctcgtatgatttgttccacaattaaatttaaatcttgtgtttcgtttgaattaccgatgaatcgatgctgaataaaataaataaaaatctgtccaattatgattctcattacggctggaaaatccaattcaggtcgtaattgtcctgttttatttaagttctctcttacattttcaatgactgattttccaggttcatttatcactccaaaaaataaatctcgaatatcacgattagttagcaactctgtaattaaaattagaattgcgtcttcattgtctcgtacaaattgataacggttataaacaaagaaacgtaccatatcttccaagtcagtgaactgccttaattcatcaataaaactatcccgaaaaactggaaataaatttataaataccggtttaagaattcccatcagtaaatcttgcttagtcttaaagtatttaaatatagttgcctgactaatttcagctttttcagcaatttgggctgtcgaagttccattaaatccctgtttagcaaataaatctaaccctgctaaaagagcttttttctgacccttaggaagcttttgctcatcaagccacgttttataattatcaaatatgattgcactactcattatttacaccttccgatatcgtttcaatccaacgatatttaaaatagttaagataactagaaaaattaataacactccaatatctccccccaaagctgaaagtcgggctcctcgcataataatattgctaaccgcatcgccggcatacttaagtggaataatataagatattttttgaacccaatcagccatcgtatctaacggaataattccagcaaagaaaacttgaggtactatcacaattggaataaattgcatcatctggaattcagaatgggcaaaagtagaaagtagaattccaaatgctagagcgactaaagctaatagcaagttgataacaataatgctcccaatattgccaaccacttccactcctaataatccaatagttaccaatacgatcactatggtttgtaatatagcaattatcccataacttagcatatagccaaatacaatttcagaacgtttaactggagtcgctaaaagtcgatctaaagttccacttgttctctctttcaaaagcgccatcccagaaactaggaagacaaagaagaaaacgaagaagcccattaaaattggtaaaatcttatcaaagaagctggtgttagcatcaccatacacataatgatttttaattttcggactagcttgagttgcgggcatgcttttggttttaactgattttttagtaactaaagctaacttcgtttgaagttcatttaaagcccggttactctgttctaaatgttttttaagctgtttaatattattcacagtaaccgcatttttgaacgccatcttagtagtggctgttttagttgcatcagtattagcataagttatattaaaattattgccgtctttttcaataattgcatctgtcttttcagcttttaatgctattttcgccgttttttctgagtcatattgatgaatttttacatgtttaatcgtatttaaattttggttcaactcatgtgaaatacctaccgttcctactttcacatttgttgtaccgctattgttaaaaataaaactcattaatactaaaattaaaattggagctaaaaacattaacgctaaagttcgtttaccccgcattaactcttttaaaacacgatttgtaattgcaataatcctcattattctgctccttccgccttcaaaaagacatcttcaatagacggtacatcatactgtcgttttaaatttttagggctatctaaagcaatcacgtttccgtccagaatcagcgctacttcgtcaacttgttcagcttcatccatcacatgcgtagtaatcaaaatgctttgtccgttattttttatccgttttaattctcgccatattttccgtcgtaacgcggggtcaattcctaccgttggttcatccaaaatcaataacttaggattacccaataaagcaattcctaaagataatctacgcatcattccaccagaatatccttcaacccgtttattaagcgcatcttttaaatcaactacttctgcaacatgatcaatttgcaattgtagttcactcgatttgatacctttcattttggcataaaattttaagttctcaaaaccggttaaagtcatgtacaatgcgtccgtttgggccatataaccaattttagataataatttacggttgggcattttagcctcaaaaatttctgcggtacctttatcagccacttccatgcccaacgcaattttgataattgtagattttcctgaaccagagggcccaatcaatcccacaatttgtccttgctggacattaaggttgatattttttaaaacattttgttttccaaaacttttagcaatattttttaactcaattattgatttattcataaaaattctccttaaccgaattaagtgagtgattactcacttactggttggagtataaaatatatttattttttagtcaataacttctaacttcatttgaagttcaattgtgagaaaatataataaattacaaattaatgcttgctagttaagctgatcttttcattctgggattactagttagtgattccttcaatatttacatattatggaaactttttgacaataaaattcaacataaccgcctattaattaccctagttatacagatgattaccttcttatttttagttttaatcggggcgaccattaactgttggttgtgtagttttaactatttgtggaattttaattacgcaaagaccattagtaaataaaaagacagctacctcagattgagacagctgtcttactattttattcgaatattttctttgctaaaccaaatgctgaccatgccttaggccaacctgcataaaacgaaagatgtgtaattagttctaccatttcatccttagttacgccattttctttagcaatcttcatgtgtgcttctaattggggaaataagccttgcgacatcagacttgcgcatgtaatcatactccgatcacgagctgaaagctggtcttcacgtgaccaaacttcaccgaataatacatcgtcattcaattctgcaaattttggtgcaaattcacctaattgttcgcgtcctgcggtctgttttttaaccattatttcccctcctcaactgccttatattgttcatcgctaactgcttcaagccattctggtgttccagcagtgatcgctacatgtgcaaaccaactatctttagttgcgccatgccagtgctttacaccatcatgggttactacaacatcaccagctgtaagatggcgtgctggttgtccttcttcttggtaccagccttctccacccgttactagtaaaatttggaatccatcatgatgaatatgccagttgttacggcaaccaggctcaaaagtaacatttccaactccaacattaacttcggggtctgaaacaagcccctgtagataactttgtcctacaaagtattttgcgtatgcatcatttttaggcccagcggggaaaataaccccgttttttactgcttcatttttcataattaaactgctccttttaaattaaatttaactgttctaaccaatttgctactgcttgatctgccttatttactttggaaccctgtactgctaaccctagcttaatctctgtgtctgggaaaattgcttttaattcgttgatactgtttcccaatccactcccttcactggtacaaaaaggataaattactcgtggtgcaaccagctgttcctttaaaaattttttaaccacattgggtaactcaccaaaccagattggtgtccccagtattaaaacatcatcactaatttcatggtttatgctagcttcagggaaaatactgtgttcatgttcatctttagcacgttccaccaatgcttcgtaacttatcggatatggtttttttggcataatccgatttgatggcaaatttaattgcccagcaatttttcgcatcagaatttcagtatttccatcttcagcatgggtaaaataagctatttccactatgcacctccgattagaaaaagccttaacatctttcgacaaaaataatgttaagactttttatgtaattcgtaaaatgcttattttatccatttctatgctttgaaagcatggtagaagtaattaataaatttatttactaccggtgatagattacgctcccgcttccaaactaaaacgcagttagtattaacttccggctctaacggaatgaatttaactccatccggatgggtattcctagttgatccttcaataatgaacgcttgagctacttgacgtttcactagtgggagcacattaaaggttaaattataatgaccgacaacatttaattgttgatagtcaatcttgctccattttgaaattaattcctgaacttcaggacgtcctgacactaacaacggcatccccattaaatcagtcggtacaattttatctttctgagcaatatacgatgctttggaaactaataatccccatttttcagtacggggaagtacaatttcgtgatatttttctgtggcgatgggcttaattaaaactgcaacatccactaagcccttatctaaacgctctgtgatgtcgtcactagtcccactgtaaatggtaaatgtaacttgcggataatctcggataaaatcctctaagattaaggctaaagtatcagaattatcggcttcaatgcacccaatagtgatatgtccactaaagagttgctttttacggttttcgaattctaaacttgtttgctgggttagctctaaaatttcttctgcacgggattttagaaacatgcctgcttctgttagttgaatctggcgtcgcccccgaataaataactccgttccaaattcttcttctaattctttgatttgtcgacttaaagtaggttgggtaatgtgcaaagcttccgctgccttagaaaccgttccttcttctgcaattgtccaaaaataacgcagagttctaatttccatttcccaatcctccaattttttatactatacttaatatacaacatacaataaaaggagcctagctacatgagtaatatatacgttaaaaaagctcaacctcaagatttacccgccatcatgaaaattattgataacgccaaagctttattgaaagcggatggtagtcctcaatggcaagatggaagtcccgatgagactactttcatcaacgacattaatcatggaaattgttgggtactgaaagtcgataatcaaattgcaggtaccgccactttactgaccaccccggatgccaactacgaaaatatttcagacggtcaatggaaaaatactagtgcaccatatgctactattcaccgaattgctatttcgcctgactaccgcggaatgtctctcggcaagttcttcctatccaatttaatcaccttaggaacgcacgctgggattaataatttccggattgatacgcacgaacttaatcagcgaatgcaacaccttgttcaacaatttaattttgaatacaccggtattatctatgttaaccctaccgaagatggtcgacgtttagcctttgaactaaatttggaaaactaaatttaacttgttacaataattaaatcaaattttgaaagggaggagtctatttggcctacgttggttttatcgcatctgctaccgtaattaaattaggacgtttttctgcataataaaatttaaggagatttaaaatgaaaaacgtccgaaaacaagttccatctttactattaattatcgttctggttggttttccacaaattagtgagtccatctttacccctgccttaccagctttaagttcggctctgcaggttaccgctcagacggggcaattaaccatgagttcttatttcatcgcttttgccctaggtgttttattctggggtagttactctgaccgtgtcggtcggcgtccagcgatgttagcaggactaatcgtttacctagctggtaacattggattactgtgcgctcctaattttgcaatcctaattctgtttcgattggtccaatcctttggtgccagcgtcggttctgtcgtaacacaatccatcatgcgcgaatcctttgctggtacaaccggggcgaaagtattcgctaaagttggggctgccttagccctctcccctgcaatgggaccattattaggcggagttactcagacttattttggttatcgtaatgtattttctgtcttaattgtcatggcagttagtttatatctatatacactccgacgactaccagaaactaatatccaattgtctaacgttactcgtcaaccggcattaaaacctattgttatgcgtcttttaactgatccaaacgtttgggtctacggcttactaattagtggaattaatggcattctcttcagtttctatgctgaagcaccttttatctttattgaacattttcatcttagttctatccaatatggtgttttaggagtagtgattgccttatctagtattttcggttctataaccattaatcacctagtcgccaagatcagcgccattcaaattaccaaatggggattaatcctagccatgtttggagccttcctattagtgggtgccagttggattggaaatatttacctctttattttatgtatttttatcgtcttttttggtttatatattacacttccaatggcacttaatttagcactcgttggttacgaagacgtgattggggtagctagtggtatctttagttttgggtactatatttgtatcagtttcttcacctatctaattagtgcatttcataccggatggattggaatcttacccttgtatatcctagcaattacagtcgtaatgttacttagctatgagttacgttttaaaaataaataatccataaaatcaaaaagacgcttctaattttaatttagaaacgtctttttcggtcatcttatgcagcttgcatggcactgatcaattcatcgatcacttttctatattctaattgcttggtgttaaagcgattgtctgaaagctcaatcagttctctatttaattcataaaaacgattaattaatgctagttcttgttcagattttagattaggtcggattgcaatgctttcttgataagcttgcattaaaaatactcgacattgacttccatcgtaaataactttactagcattttgaagctgggtgattaaatatttaaacatcgtatttttcctttatcaaattagattaaagtggcctttttttcttcttttaaaacatcattcatgcgaccagacttgaaaccatctacatcaagagtaacgtagttgaagcccaatcctttcatgaattctgacatttcagccttcttagctaataatttggcaaattctacttctggaacttcaactcgtactaaatcgctgtgcacacgaacacgaacaactgggaaaccagcgttacgtagccatttttctccagcaaatacgttgtttactgcttctgcagtaagctttgtaccatatgggaaacgtgaagcaacactacatgaagctaccttgttccagttagaaattccacgatctttagcaagttcacgaatttcactcttgtataagtcagcatcttgtagtgaacttacgatgccttcttctgtacgagccttcataccaggacggaaatcagcattatcatccatgatcattccgtcaagcacgatatcaaagcctttttctgctgctgcctttttaatagttctgtataacaattgcttactgtaataccagctttctggtgtgttagctgcaattctttcatcagctaattcactcatgctaactcccattgcgtttgcaccaaggtccttagccaattccaaagccttattgtattcatcatccaagaacaattctgagttaactaccatagctaacacattgtcttttcctaattcgtctacagccactttaagtaagtatgtactatcaattccgcctgaataagcgattgcaactctttgctttgatgctaaatccttaattaaattattttcttttgcttctaagtcagtcataataatgtttctcctttaattatcgatttttttagtaaatgtgtaagtaaaatctaacaaaagctgctgccaaaattgaaccaacaaatggtgcagttcctggaacaattagaccatattgccaatcattattagctttatttttaataggaagtaattggaatgctaagcgcggtcccaagtcacgagcttggttcatcgcgaatcctgtcgtacctccaagtcccataccaatggcccatactaagagtcccacggctattggtgacattgaatcgtaaccatgaacgattgctagaattgatgttaggaaaacgaatgtagcgaatgtttcaacaaaatagttacgtggtaaattacgtaagttaggattagttgagaaaatatttctaattgcgattggatcaattgaaccttctgattctttaaagtgatcagcatacataatgtaaacgatcaccgctccaactacaccacccaatacttcggcgattgtatagggaataaagtaactccaaggaatcatacctaaaatcgcttgagtaagcgccatagcagggttaatacatacgccaccaaaaataaataacacaactgaaataccaaatgcccaagttgtaattgcaaataagtgacctgaaccggcatatttagttttctttaaaacttcgtcacaatgaactcccacaccaaaaattatcataagggctgttcccataaattcggctaatagatgatttaccattaaattaaactcctttgttatctacttaatataaattctgtatttttttatatgttgcttgtaatgaccaatcatttttagttgctattttttcgcagtcatcaaattctggtttaaatttttcaatatcttgatattgatattttttaattcgtaaattttcattttcgaattgaacttctttaaattctcttttcataatccgacgttgcatgccctgataacgaaaacctgctgtattggtatgcttgaaaattaaataactgatttcgtcaaaggcttcaggtttcaccaaaacatttagcaaaatagctggccgatttttcttcatctggattgatgaacaaaaaacatctagagctccatgttctaacaagatatccatagcatatccaatttgctctggagtttgatcgtctaaattagcttcaattttgatgatgtcgtcatgattagtttttacttcctgattactgtgttccacagttagcaatgaaccccgtaaggcattaaattttcctgtttctcgttttccaaaaccataacccacctgactaaagtacatgttttctggggccgtaaattctggggcgatttctttaaacaaagctaatcccgtaggagttaccaattccgttttaatatcaaaatcttgaacgatttttaatggataatttttgcgtaattgcattactgctggaactggaactggcatttctccatgtgcaacgtgaatcgtgccactcccttcagtaatcgatgtcgaataaaccttatcgatttttaattgctcccaaagaatgaagaaactaatgatatctacaatcgagtccacagctccaatttcatgaaaatggattttattaacatccgcattatgtacagctgcttccgctttagcaatatctttgaaaacattgctgctgtgctttttgactatgccagaaagatcactactttcaatcaagcccagaatttcagtcaatccacgactttcatgatgatggtggtgatgaccatggtgtgaatgttcatggtggtcgtggtggtcaaaatcgccttttattccagtatctttatgctggtgagcaatttgaacatcgaaatccatcccaaaaatactacttttattagttctttcaacttgaattgtatagtcttcaagcgtaaatttacttaattcttcctttaataaatctaaattacccccaagatccaaaagaagtccattaagcatatctccacttagaccagagaatggttctaaatataaagctcgcataaaaattattctccttctctgattttattgataatgctagcgttataagctgccccaaaaccattatcaatgttgacaacacttaccccagatgaacaactattcaacatgctaaataacgccgtgattccgtctaagttagttccataacctacactggtgggaaccgcaattaccggcttgtccactaagccaccgactacgctgactaaagcaccttccattccagcaatcacaataactactgaagcatttttgatgtcgtctaagttaacaaataaccgatgaattccagcgacaccaacgtcatagattcgcttgacagaattgccaaaagtttcagctgtgatagctgcctcttcggccactccaatatcagaagtacccgcagttacaatagcaatgtatccatctgttaatttgctagatggatttaaaacaaaacaccgcgcgtctttatgatagattccgtcaggaaatttctgctctaaaactaccgctttttcagcagaaactcgcgtcgatagaattgccttgccttcggttaaaagatcttcggttatcgctacaatttgctcaaccgttttgccttccccgtagattacttctggatagccgtttcgggctttacgttgtgtatccactttggcaaaaccgagttcagaaaacccagataattgcttagctgcttctgatattgatagttcttcgtttttaacggattgtagtattttagttacattcatctttgtttagcctcttagtctattattcaacgattaccgataatccatcacgaataacggttactttagcttcactgccttcaatttcaaaggctttttgcaatgcttcatcaaatgttgttgctaaatccatgtgcatactgcggattaattcaggatctaccaaatcagaaacataaataacatgatgatgaaccaaaatacgtgctaaaatttgtgaagtccattgatcaggaacagtttctaatcttggtgtgttaattgcttgatctaaaaattcttttggatcgtctacatcagctaaattatgatagaaaccttctccaccatgtccatcactagagccggcaaccataatgattacgccgccttctttattagttgcttcagcagcggtcattccctttacggcttgatagatattttgatcaaggggaaaaccaccattggttgaaatagcaatatcgctaggagccttcttaacactagctaattctttaacaaaatcacaaccaactttatgagctgcttcaacatcacctgcaaatgaaccgatgattttcttatcaccatctaaaacaacgttgacaatgaaagccaattttgcggtgcgagctgcataaaccatatccttatgaattgggttatgcattaaattacccgtacgggctttattagagttaataaattcgccagagtggttagccataattgttttatatgatgcaataccaggtaaaacagcttttctaccaccagagaaaccagcaaaaaagtgagattcaataaacccttctgctagtaacaaatcggcttcagcagcgactttattgataatgcaatctccaccagaaggtagttgtccaatttttaccattgaatcatcgtctgttgaaaaatgcattacgatttcttcgttctctacaatttctgaaccatatttattaataagttcttctttagtagatggacgatgaaaaccggttgccacgaggattcgaattcttgcatctggagctaccgaacggattcgacgtaaaataataggtgtaattatatgcgaaggtactggtcgagtatgatcagaactaataagaacaatgttcttctttccctttgcaagttcttctaagctgggacttccaatgggattgtccattgatttttcaacagtttccttttcacttaacggattctggaaactttcagctttagattctaataatccagcaaaatttttgtctggaatattagcagtaatatttcttttatcgtacggtaggtcaatttgtaccataacttaatacacactcccttatttttggcgctagacaatatattaggctatgtaaaatcgaccgggtatcacatttgggtataacatttgttacacttctcacaattttttcttatgataatagatgtctgtacatattatttacttttagacatatggagagttaaaaaatgaacactagctatttaattgactttttagagaataaacaggtttctacaattaccaaaacaaaacattcctatctgacctatcatggtttagaagaaggttatacatatgtcttgaaaaagggaattgtcaaaaccagcatcattttaaagaatggtcgagaatttaacctttcttatataaattcgactgatattgtttcgcttttgagagatgaaatttctgcctatacggcttcgcctttgaacgtgcgtattgaatctgacgaagctattttttatcgcatcccgcgtaaaacattttgggattatgttaatcacgatactcatttacaagattacgtgcgtgactactatcgaattaaattaacccaaaatataaaatcgttacaatggatgactatgaacggtaagaaaggtgccgtctgcgcctttatctataagttaattgatatttttggtaggcgtggagcgactggtatcttgattgattttcccattactaacgaagaaatcgccaatttctgtgggatttcaactagaaacagcgttaatcgaattattcatgatttaaaagaacaacacgtaattgatatcaagaatcagaaaatttttatttacgatgaaaattatttacgtgaatttacaatttaaaagtttggggagatatcactatgaaaaagaaattattttatggagcacttccatattacgcagccagcttggctatccatattttgggcattatcttactattagttgctgctcaaaaacatcctagtttcttgggattaggtgcgttagcctacactcttggactacgccatgcctttgatgccgatcatatagctgcgattgataataccgttcgtttattaattcaccaaaagaagcaaccttatggagtcggatttttcttctcattaggccactctactgttgtatttctaatggctttagtcgttagtatttctgctaaatgggcccaagttaagctacccattctagaagccattggtggaaaaatcggtacgattgtatccggtagttttcttattttaatcgccttttttaatttaatggtcttaatcaaactttataaatcactgagattagtaaaatccggtcttgatgaacaagaattaaacgatttactgctatctagaggttttattgctaacttagtttctcctttattcaagaaaatcgttcatgcttggcagatgtatccaattggattcctatttggtttaggctttgacaccgccactgaaattgccttgattgcactatcggcaacggctgctcaatcaaacgtatcggtagccggaatcatcgccctcccagttttatttgccgccggaatgaacgtgatggatacaaccgattccgtgatgatgtcaggtgcctacacatgggcatttgatactcctaagcgtaaggcttactacaatttaaccgttacttttgtttcagtcattgcagctttcttaattggtttagtcgagttaggcaacgtctttgctgactttacccacgttaattctagtttcatcacatggattcaatcgattgatttaaattggctgggctattgtctggtaattgggttcatattaatgtggagtttggcttatcttttttggaaattatttattcagaaaaacgaacagcacgcataaaaagaaacagcatttcaactgtgaaatgctgtttctttttggactaattcgagtgaatacaaaaaacacgttcctaatatcagaacgtgttgcaaactttttaaaacaaattattttttattaaatcatgactgtaattgttgcagcaactaagattaatactaatccaccaatggttactgccatttcttttggcgtcttcttttgacctaggaaccaaattccagttaaggtagctagaaccactgaagtttgtgaaagaataaatccagtggccaagccgttcatgtttggttgagctgaaattaaatatgtgagtgcagcaaaagcaaagaagaaaccagaccagatttggcggtaagatactgcttcagttaatgctgatttttcacctcgcattgagaggaagattgcatatactacaccaacgattaccataccaattgcttgaggtaagaatgcatgcattccatcgactgatgtagcttgaggagcggcagaatatgcccaataaccaatttcacctacagccaaccaagcgactgctttagtaatcaattgggtattttctttagacttatgttctgaccagaccgtgagtgaagcaccaataataatcaagactagcgcaactgcaccaataattttagccgtaactccaggccaatttcctagagcaatcacaccccataatgaagcacctaacagttggaaagcggtagtaataggcatggcccgtgaagatccaatcattgcaaagcacttaaatgtaataatttgagcgctggcccaaccaatccctgaaataacggtaaaaaccaagtccattccagttggtaaggctaatcctttgattagagcaaaaacaaaagcaaagataaatgttccaaaagctgtacctacaatctgatttaccggacgtccaccgaatttagatgcaattgttggaaataatccccaacctaatagtggtccaagtccgattaataacgctgtcgtgttcatgtaattcctccttaattaattgacgaaattgctaaatttaaaatacaacgccactttctaaaataatattagaataaggagtcatttcaccagtacgaacaaatgcgtggcaattattcaaatcttttttcatatctgaatgtggcataaaagtaattggtgtttcaggcattaaagctttaatattttctagcatcttaggattttcggtcttaatttcttctgctagataaattctttgaacttcaagttcttctaaaacgttagttaaaacttgcatgaaactaggaattccattatctactgccaaatcaatcttttctgtgcccattggaacgggcattccagcatcaccgatacttaatttatcaaagtgacccatttgagcaattacccgtgacatatctgagttaatcattttagttttcttcattgttatttcctcctatttttccaattcttttttgtaagggattgatggttgagcaccaaagcgttgtacagttagggatgaagctttattaccatataagatggcatcttctaagttactaaagtctttattcaaaacggtgctcattgctccaatgaatgtatctccagcggaagttgtatcaacagcctttaccttaaatgcggggataattccacttttaccattaacatcgtagaaggttcctttgctaccaatggtaatcaaaactgcttcaattccttcatcatgtaatgctttagaagctttcttcatacttgcttcatctgttacttcgattccggttaaaatttcagtttcagtttcattaggaatgatcatatccgttactgctaataaatcactaggaactttttcaaccgctggagcaggattcaagattgttttaacgcctgcttcacgagcaatcttaaaggcttccgtaactgaatctaaagaactttcaaattgagcaataatgaaatcactatttttgattaaatcagctttagactggacatattctggagtaaatgcagtattagcacccgcatgaatcatgatttgattttcaccagcgtcatctactactatgtatgcttgtcctgtagattggttatctaaagtttcaattccgctcatatcaatattttcatgttccaataattctaacattgcacgaccagcatcgtcattaccaactgcaccaataaagtttgtcttagcttcagaacgcttagcagctacagcttggttagctccctttccgccgccagctgaaaaaatttctttcgtatgcatggtttcacctggttttggcatttgttttactcggatagtacggtctaagttaatgctcccaataattgttacagtgttcatgatggattcctccgttttcgattatctttttacttgtttaaaacgttttatgaaaacgttttaatagcatatcaaaaatatagcacattgattctattaaatcaaatgtgctgtggaaaatcttttcactaagtgaacgggtaaagtcttctcttcccagttcttatcaggagtttcaattctttcaagcagcatgttagctgttgtctgacctaactcaaaaataggttgtgcaatagtggtcagtttgggaaccatatattcacacatatcaatattatcgtagccaatcacactataatcttcaggaatctgcttaccagcttcggctaatcccaaataaattcctaaggcaatttcgtcattgaccgcaaatattccggtaacatccgttgctaaaattttagcaacggcttcccgaccgccaatttttgatagctgggcatcgataatttcaatttgtttttcttcatatacagaacgtactccagctaaacgaccacaaacattttcaggtgcattagtcggcatgactatggcaattttttgatgccctaaatctttcaaatgttgagcggcttgagctccacctgaaaaatcatctgttaaaacggcgtcactaattccatcagcctttttctgatcaagaacaataaatggatgatttttagcttttaaggtggcattaatagattcatttgaaattactgaactagcaataataaacccatcaaccccacgtcgactcaattcagctaagtaagcatcttctttttcctggtcaagatctgcgttacaaagcatagttataaatcccttttgataaaagatattttcaattccacgaactaattcactaaaaaatggattggtaatatcgggtactaaaacaccaatcgttttactttttttcataatcattcgacgagcaaagtaatcgggctcataatttaaatctttttttgcctgaattaccttttttaccgtaagtgaactaaaccgagcttcatttccatttaagatttgcgaaaccgtcgagattgaaactcctgattgtctagcaacatctttaatcgttatcttttttgtttccattttttcacaccaatacctagacagttattttttatatttttagtttacaccataagataaaaaaatacccatttcgtttagaaatgagtatctttgaaacaaactttgaagttcaatttaagttaattaaacgcttatatatcaggtcttatttgattaaacctagcgtttgaaggattaaatatatatttaacaaaatcaagacaattgttgcagtccaagcacaccattttacccatgctcgattagcaaattcacccatcaactttttactgcttgtatatataaccagaggaattaccgcaaacggtaaagccacacttaagaatacttgcgagaacgttagtaagttttcaattttagcttcatcaccgtggtaataaatggcaaaaatcaaaactggtgccacagaaaggactcgagtcaccaagcgttgtacccacaatgggacacgtagtcgaatgaatccttccatgataatctgaccagataatgttccggtaattgttgagctttgtccagaagcaagtaaggctacagcaaatagcatactaagtactgggctagcaatggccccaacgatttggttattacttaaagcattaaacaaatcaacgaaacgtcctagtgaactatccgttccatagaataaggccgctcccaaaatcaacagtaaactattaacaatgaaagctaagaatagttgcatattagagtcaatcgttgaaaaacgaattgcttgagcgacattttcccgatcttttcggtccacttcacgagtttgtgaaattgaagaacccagatacaaatcatggggcataactgtcgcaccgacaattcctagtgacagatacaacattgagttattacctaaaatctcaactgaaggtacataccctttgataatccctgaaatacttggatcagaaagcagtacttcgtacgcaaaaacaattaaaataacagcaactaaggttgcaacaattgcttcgatttttctaaaaccgagcttcattaatagcagcaatatcaaaacatctgccgctgtaatcaaaataccaataattaatggaatatggaataacagctccaatgcaattccagatccaataatttcggcaatatctgtagccataatcgctaattcagcgacaatccacagcaagaatccaactcttttactcgttcgttcacgcgttaactgtgctaaatcttttccagttacaattcctagtctcgctgacattgcctgtaaaagcatcgcgattaaactagaaagcaaaataactgaaaggagcgtatatctaaattgcgccccacccgcaattgatgtaatccagttacctggatccatataaccaaccgcaattaaaaatccgggtccggagtacgccatcagcgtcttccaaaagcctgcattcttaggtaccttgatactaccattaatctcgtccaggctcttactatctacttcatcaagtttttctgacatattgagtccctcttttctattggtttagaaattcggtaacttgaaataaactctccaccataaaattgatccatttttataagaaagcaaaaaaatggatcaatccaccaatgaattgttagtttttatttttctaacggagcgctcttttcaaaaaccataactactataccatattaattaataagagtggcaactaagattcggttttaaggctaattatttcactatttccttatactgaattgtcttcatagataaaataatttatacacatcaaccttgtatcccctacctgaattttttagtttatgttagtctggaaaaatccaaaaatttgaaccaagattgttgcaatgtggatttatcatgcttcgcaactctaggttttgtcacctataatttgttttcatctccctaacacataaaaaacatacagagcattaaccgcccctacaacccaccagttgaacgtaaaaacatcgggtaggaaagataccacccaccaactcaaaccgcttgtaatcagcgcaaataagataatccgctgaattttatcccttcgtttcattttttcaccacgcttagttctattattaatctacttctattcctcttattatacttaaagtactaaaaaagctgaaaatcacaattcacttgtcattttcagcttactcttaaacattaattttatttactttttgtaaaccatctttggtgactttaaataaccccgttttataatcctgatggtacgttttttccagcatggtcgtaaatgttcgatgccattcaggtaacaccacataatcatactgtttaatggtgtttttgaactccgcttgagacatcatgaagttttcctgtccaacaacttgatcggaaaagaaataataacgtcccacataacccgcgtaataattatttacatcattaaaatgtgggtcaactaatagaattttctgatgattgtactgagtactctgctgagctatttgttttaattgtaccggcaattgttctttacctaaggtgttattgtacttaattccgttaatttcagaaaacatcaaaatggaggcaaacaacattaaaaccaatgatgataactgataaacatttttggtaataacattactgaaagatcggattcctcgtttactaacatcttcttcaaaactagctcggtccatcgctacaaccagcaccatagtcgctaatagcaggtttagaatcaccatgcttgaaagatagcgttcagatccatctaacaggattgcttctgcatagggcattgaaacaatatacatcgcaaatacactgatgtaataggcgataaaactgatatcaatagctattaaactttttagcaggttattctttttacgtaaaaaccagcgaataataatccaagctccgagtagaccgacgttaataagtaatactccacgcgtcgatagcgagttaaaactcaaaatctgatgtaaaaatttacttccaattttagcaattacggctgaactttcatgggctaactgactcttgtacgcatctgtactaatttgatgttttgacacagcgctgaaagttgcatgcacatgctgattccaccagaagaatggtaaatagcctagtcccattgtcacgacggtttggctgatgcctttacccaggcgtttccagcgttgaccttgtccattggtaactaaagaatacaacaaataacagcctagcatcactacatacatcgttccagaatttttaatcagtaaaagttccgcactaaataaagacgctgtagcacactgcaaccaaggcgagcgacggtaagcataaactcccgcaaatcctgcggcggcgactaccggaaggacaaaatcaactaataaattattcattcgaattgaaatattaaaaatattaataattgaaacagcaaaacagattacaaatgagttggttgaacgagttcgatcccgtaaaaccgcaaatattccgtaaatactggcccaaatcaataaaaactgtcctagtaacatagcaccatcactaaaacctacccatgatacaaactgagtaatgaataaagccgtcgccggtggataagaagtaaacgaaataatggtatctgccgcaactggcaaatgaccttgaaataggaggtattttatgattaatgcccaaagtgaataattatcatagtgaatcaacgggctggcaaataagatgcgtcccataataattccgataacaatcatccaaacatcaaaataatggataccttcaaaaggtaactttcccactcggaaaataattgatccaattcgaactactacaaaaatgcagcctaaaataacgactgcttttagtccaaattttaaccaatttagcatcgccaaaacatacaatagcaacgtttgaattaccatcgatgtaatccaggacatgtatttattcacacctgccatgcgaaccatcccagtatatccaatttgggccatgataaagacgattaatcccgatattgacataaaatacacctacaatttcttaaactaattaccgttgtctcataaattgagtagcatttctttctaattctttcattcttagaataacatttaaatgaagttcatcaaaaggcgtcatccagtggtcttgctcttttgataagaattgattctccccatcgtaaattaactgaagataatgatcttgatcttctttcttatcaattttgactaccaccccataccaaatcggttccgtatctaccgctcgagcaacagtacatttaaacttaatcggaaagttttcgtgataaataattccttcgacttgatcgttcatttttaggcgtaagtccttattaacaaattcaaatgaaaaaccaccatctgaaacatcacgggttttaaacttagcccattcgccatttaccataattttacctttagcatgccgaacaaaccgttcactcttacgattgatatcacgtttcatggaaataaataaacagaagcttaggttaataaagtgcattactaaccagaaagtgataacacttccgacaatgatttctgatccccattttccataattgaacttcacaatcgctaataaggttaaagcccacataacaaaatatggaataatgtagagtttatccacaatcgaaaatttaacatttttatctgttaccttaaatttcttagctttgatcccaattgattccaaaataactggaataaacaaatatggagcaaagaaagtttcctggatttccccccagcgttcgtttctgatattgctggaagtatctcccaaaacaaaatgcaataagaagtatcctggggcccaaacaatcattaaaatccagaaattagcattaacagcttgaactttgaataacgcatacaataacggagctgcaatataaattaaccgtctagaaaatgaccaccaataaagccatgtattaatcaaaataattcgattaagtaaggtaatcttcggattagtaaagatatgcatgtttctgcaactctgaataactcctcgagcccagcgagttctttgcttaataacactcttaatatcaactggtgtgattccacttgaaacgggttcacgagtagcaatactaatgtaaccttcactgttaatctttgttcctaactcaaaatcttctgtaatcgtatccgttggaaatcctccaactttatcaacaatttctcgcaaaaaaactgcgtttgatcccgtaaacaaggcatgtccgttagaaccatttaacacattgacatcccgcgaaaagaagtcctgttcatttactacagcatcttgcaaaaagagattaaattgaaaaatatccgcattataaaaactttgaggagtctgaacaaacccaattggcttagtatgatctggatcctcttccaattccgcaaaattttctgtaaaaaatgggacactactagttaaaaaattagaaaaaggcatcatatctgcatcaaaaatagcaaatagaggtgcatctaactgttccagcgcattattaatattccccgctttagcatgtttatttttttccatcgtcacatagttaacctgatattctttagctagttctcgtacttctggacgattcccgtcatctgcaattacgatattaactttacttttatcaggataatccataaaggttgctgcattgactgtttttcttagcaacgaaacttcttcgttatgcgtaacaataattacgtcaattttaggaatcggctgttgcaaattaaacttaggaatttctagtttttgggtcttatctgctcggattaatctaaagataatcaatacataagcagtaaaactagaaaagatttcactccctactagcaataaagcaaaaatcaaagtgaatatgtgcgcgtgccatggaatagtaaaaaatatgcgccacaacagataaattactgataaaacaatcgctaaaatataactaactttcttgatttttggcataatttacctcagtatcttttttgaaaataaagtctttttgaatttggtaactaatgataaataatgtgaagtcaaccatcattttagccaacatgggggcaatgctatttccattatgtggtaaccaattggtaactaagtccgttagataacctgaaagaatcatctgcactataaataaagccccgtatttaatgaaagtttgccgcccacctccattaaaaacaacgcgatgattcagcgtataattaactaccgctgaaagtgctctagaaataactgttgctaggataatactatctaacacatggtttcccattagtaggataattccttcaaaaagcgcaatatcaacaataaaagaaataattccgctccctgcaaatttaaagaaacgggcatagattgcaagcgagtctcgaaccactcgaaaatgagatgacttattaccatccaaataaatggttggaatgggttgctcaatcacttttacatcgtatttacgcgcctgaagcaacatatcaaattcgaactcaaaacggtctccaggaaattcaattaactgatctacatattggtgaggaataattcttagacctgtttgtgtatctgagatattctggtgagttaacaacttcactaatttacttgttaagacatttccgaattgacttcgtgcgggaatttcattagtaaatttacgaactccaataatcaagtctgtgggattttcttcgaacttctccatacatgagcttaaagctcccacggtatgttgtccgtctgaatccattgtcgcaatcccttcgatttctggaaaatagttgcggatataacggaaaacatttttcaacgccgcgccttttccttcattatgttgatgatgtaaaacatgaattcgctgttctccaatttcctcaagttctttaaaaacagcttggttcgtgaccgcactgccatcatcaaccaatactagcgcatcaaaattaatcacattatttaataattcatggaccaatttaattaacttttggtccggatttaaagctggaatcaaaatcccatattttttcataatttcacctattatttaaactcaaaataaaattttccaccctatatcatgatacactctatacaccttaaagaagttcattaacattcaaatgtaataaaagtgtaaaataaatcgttttaccagtataaaacacaatccgtttgtacattatctttcaccctagtaataattcacgctgtaaataaccagcgaaaacccattatacttaacttatttgactaacgcaataaactttgagacgtaaaaaagttttttattgaaattaattttaaacaaaacatatctaaaatagaaaaatactctcaatgtctaagttatggtatcatcgtaaatgtaagcgtattaacaaacaaaaacggcggtgacttaaacagtggatttaacaattgtacgacatagtattagtagcgataacggtcgcggattaatttcgggggctggttctgatgttgatctttcagaagctggaatcgagttagcccaagaggctcaacgtgcttttgactggaatcaatttgatcaagttttctccagtcccatgcgtcgggctaaacaaacggccgaattactcttaggtgaccaagcttcagcgattaattttgatgaacgtttaactgaaatgaattttggagactgggatggaactgccgaagacgcaatttttgaacaatatcctgaaattttcaatcaaatggggatgtttaatgagaagtattccgattatgcacccaattcagaaagttacgatgagctggttaaccgcgtaacaggctttttagatgaattgaagcaaaaatatccgactgcatcaatcctactcatttgtcacggaatgactacgcgagctctctttgctgccttactccacgtcagtcctgcccaatttggtaagattggcaacgttactttaaatcaaattcatctagatgaaactaatcattttgaaccccgcattgatctttacaatcaaaaattaaattaaaaaacggattgaagcctccaacatcatgaaggtttcaatccattttttgtttacacactagctttcgaatttagatatttcttttctgcttcctttcgggcctgaacagcgtcttcaaagtcagcaaaacttgaatttaaaactaaactacccttaaccatcatcctagctaaccatctttgagcgtggttatcaaatgacacaccgattacaccgctggtatttctagccccaattttaatggactgaatgggatttccattaacatcttttaacgcatcaatatttcccatcctagctaaagtcgcttgattagctcggatttgataggctgctttttcttttcgtaagcatccacaactacgtacgctaccacgacgtaggcgataaccatccgcttcaataatgtttccacatgtacactcacaaacccaaaaggtgttacctgcggcactcttctttgatgcaactcgcaaaacttttaatctactaaattgttgcccagttagatcatatctaacccgtgagcaactaccgcagcttttagtgctacctaccttcaaatgctgtaactccacatctgtttcattaccacaatcacatacgcaatgccagattgtattaccatttttagctttgccagaaggatacttggcaactaacttaccaaatcttttattagttatatcaatccgaattttcatgaccaacctcctcatcagggtgtgcattatttaagccaaaatacacatgaagttgtattttgaaggtacaccctaaaaaaacaattaattaccttatatttttaaatatatcactagaatagttcagcgcctaaactaagtatagctcaaaatgcttatcgttaaaataacttttttatacgatatagtttttgagcattcttacgaaaaaatgattcctagatttcatttttaatccgataaataagcgtccgactggttccggttttttgactaatactggtaactttttgaccagcatttaacatttcgacgatttcaaaatacgtttttcggcgtgcttgatttttaacatctggtccaaaaagaattggacgtcctttataaaccccccgctttttggccaattcgattccctgacgttgtcgaatccgaattcgctttctttccgactctgcctggaatttctttgtctcgataaaaatatttctcaagaaattacgcatgtttgcatcatcaatatcatcaaaagtgggcaaatccaaaataactaatttggccccctttaaataaacttccataaaaatgtgagtaagatattcattgtttcttcctaaacgttccatctcgataacgtagagttcgtcgcccggtttaaggcgttttaaaaccttcatcaattccggacgttcattgattgctccagatattttttcctcgtaaatacgatccattccaacttcttttaaacgttgtagttgacgtgccaagttttggtcctgcgagcttacccgagcataaccatatttcataaataaaacctcctagattttagacctttaaatgtctgttttttagggtgtgtaccctaaaaaagcattgcattatatatgatattgcctaagcggtataatttttagcgttaattagttttatttgtttctattaatgaaagaaacctttattttattataaaaatctctcagaatgaagtgatttagactatctacatcctgattcaataaaaatagggttacgacatatttaaatacgtcgtaaccctatttattttgtaaatttgttaattaaagttccgttagtgcgtcgtcaatattttggtcaccatcactcatccggataacttttttgattgtattatcatgtttaagtaaggctgccaaaacctgagcaacgtttggaatagcattttgcttaccactaccgttgatggatacttttccagtacctttttcttcagtaaggctagcaggttgtaaaatagtataatctaatttggtattagaaattaaataattatcggcaaagaacttagcgatattataatcagttaaatctgctaatccttcccgatgccattcctggggttctaatgaaaacattgagctgagcatgataaatcgtttaattccatttttttctgcagcttgcataacttttactgctccaaaggcatctgtctgcaaaaggtcctttccccgagaacctgctacaaaataaactgcgtccacatccttaatgcttttggtcatttcatctacatcgtcatgtaaatcaaaatgcactggagtgacatgttctaactcaattacccgttcaatctttctggctccagctactacttcatgaccatcgctaaccaaatccttaattagattttctgcaactcgaccagttgaaccaactacaaaaattttcatattccgcctccattattaacttaatctactgccattatacaaaagatacgaataatgcgttggagagacgacttatcttctcaagctttatcaactggattgagcaaaacaccatttgatttaatttctattgagcttgcaacgtaaaatgctcaccagtcgcattcaatttgctttcaactagttcttttaatttttcaatggctgatttcgcacgttgagcttgatcggcattaattgcttcaatcaccatgacagcatcagttgtatcttcagttaacatcgttctctgggcttcacgccaattaaaacaacgacaaatcgcaccagttgcgtcataatagattacttccccaggtaaagctggttcatcttcatctgagcctaaaggacgaaaactttctcctccctttgccactcctagatgcatggttccatccattttttgtaagtcttctccgccacaaggaaccccgtattccaatgaaatactattatagatgtctaccaatggattaatcggacttaatgatttcccttgagacacgcgtttcaaaagtgcttcaattgaagcccgcgccccttttttctttttaaatttagtaaaagcagtccgccactcactaacgactggattatctcgaaaaacatcattagcaatatacttttgtgatttttctattgcactatctaataattcctgataatattcatcagctttagattggttattaatccctttaaccaccaaaacttcaaaacgcgcctctggaaacatttgccaaatttcttcatcaattttcaatgcttgcatcattaattcctcctttatgagttatccttgcttattatctattaaaataggtgcaaatgcaacaaaaatattagtaaacaaaaaagtcccaattcaaaccgaattgagacttcttgaacttaactaaaattagttaagctttgttttgctttgtacttcaagcttttcgttgaagtcgtagacaactggttcaccagtagccatttcaagattaataatatcttcatcagagatattttcgatgtacttgctcaatgcacgtagtgagttaccatgtgcagcaataataacgttcttgccatcgattaacttaggagcaatttcgtcttcccagaaaggaataacacgttcaagagtaaccttaaggttttcaccaccaggaatgatacgtgggtctaagttagcgtaacgacgatcgtttgctgctgaaccttcatcatctgcatccaatagtggagggagaacgtcgtatgaacgacgccatgtgtgaacttggtcatcgccccatttttcagctgcttcagccttgttttggccttgaagagcaccataatgacgttcgtttaagcgccatgtctttgtttcaggaatccatagttggtctgaaccttccaaagcatagtgcaaagtcttgatggcacgagttaatactgatgtgtaagcttgatcgaattcgataccagcttccttgattaacttaccagcgttttgtgcttgtttaacaccttcgtcactaagatctacatcaacccaaccagtaaattggtttgataagttccattgactttgtccatgacggatcaaaactaattttgccatatcgtttaaatacctctttcttgaattaaatttctaacattataattttacaatttttgagcaattagtacaaactgaaaatgaagaagtttccacaaaaagccgattaactagctaaaaactattcttcaatggtatcatttataggaatatcttcattttcggttgaccttgattttgtcttagaggattcagctttagacgaactaccagtctgttcattttttttgtagaactgttctccgttgcactactgctggatgactcttttgcattagacttagctgtttttttagtaacgcttttactactattttgcttactaggaaccgttttatctggcacagctgtagatgacggaattggcccgccataacgtggtagaccctgttggcccgatcccgtttccatactattctcgttattatccggcgtcgtatccgtattaaatgaattttgatccgctacaattccagcgttattaaaacgctgaagcactagggcttgatcataaatcgtcttgtaatactcttttgaaaattctttatcgcttaagagcccatcaatgattgcattagatccgtaaaaatcccaagcttcatttttttgcttagctgccgttaattttttattgaattttttaacattctgcttaattttatcaattaatttaactttagtttcgctccgctgctttaaagtggccgaagcctttttataggtgagcacagtttgataatccccacgcgcactagtaaattcattactcttaaattcagaacttgctcgcatatacattttcgtttgtgccagtaaattagcagcttgttggtcatctttcctaatggttatggctcgtgaaaaatagtttttagctgcagtgtaattggtctgatcaattgctgtttttccattcgtgatattgcgctcatactgtacttgttcttcgtgataatgagcgactgcatatccgccaacaacaccggcgaccagaaaaattaacactgcccaaatccattttttcattgcctaacctcctttacatatctgatttattataccacgtaaatagcatttaacttactgcttagtcttgaatataatgcttcacatttgaaaaaaatgtcaacaaagtttataacagtaatataactcttttattttagaaaggatctgacacaatccttgagaaacaattttacaaatcgtttttaaagcggacatttaacattccagtacgcgtcaattactgggatggaagttctgcagtatatggaacgggggatcctcaagtcaccataacctttaataaggccatcccagttaaagctattctaaagaatgcttcgattgcactaggtgaggcctacatggacggtaccatcaccgtcgaaggtagtttacaacaactaatcacatcggcatatgaaaatgccgatagtttcttccataataagaaatttattcattttctccctagacaaggacataatgaaaaagaaagtatggaggacgtccaaaatcattatgatattggtaacgacttctaccgtctttggcttgaccctaccctgacttattcgtgtgcttattttgaaagtgatcaagatacccttgaacaagctcaaatgaacaaggttcgtcacattattcgtaaacttcatccccaacgtggtaaaaccttgcttgatattggttgtggctggggaactttaatgctcacagctgctaaagagtttgatcttaaggtggttggagtaacattaagcaaagaacagtacaatctagttaatcaacgtatcaaggacgaagggctcgaaggagtagctgaagttcgtcttcaagattatcgtgaactgggtgatgctaaatttgattacatcactagtgtaggtatgtttgaacatgttggtaaagaaaatctcggaatttactttgaaaatgtagcaaaataccttaaaaatgatggagtagctttaatccacggcattactcgtcaacaaggtggcgccaacaatggttggttaaacaaatggattttccctggtggatatgttcccggactagttgaaaatatcgatcatatcattaatagtggtcttcaaattgacgatatggaaccactacgtcgtcattaccaacggacaactgaaatatgggacgtgaacttcaataagcatcgtgctgaagttcaagaaatgtttgatgaacggtttgtgcgcatgtgggatttatatctccaagcatgttcagcatcatttgaatcaggtaatattgatgtcattcaatatctcctcactaaaggtgctagcggacgcgttctcccaatgactcgtgactacatgtatgaaaaataaaaaaagattcatgccgaagacaatagttagccttcagcatgaatcttttttgtattaatcgttcaacctataagctatataaaaaacacgctcatttcaacgaatgagcgtgtttaaaattgcattttacaatatttattattaaattattaacgttaaaatcattactgttacgagccctacaataactgacatcgccattgagcgcgtccaataggcaattagaataacaactagcccaccaataatcaaggcaagatttccactagtaactaacgtatatttgcttgaaataaagattcctttgacaaccaatgccgtaaataacgaaattggtacgtacttcatccaatcgttaaaccactctgggatttggcgctttgaaaagaatagtagtggtaaataacgtggagcaaacgccacaaagaaaccgagaataataatcaatagatgatctaatgaactgtactccatgcgtgatttctcctaccaaattaaagaatatctgactcttttttttcgatttcttcgatgattggaccacctttacgtgaaccaatatcttgtaataatgcactcgctggtcgtttttttactagtaactcttcgattaaaaatccagtaaatgacgcgatcaaagttgatgccacgagacctaaggtactcttagttataatcatacatactgcagcaagggcacctgaaaagatacaaatcagcaatgaaagtcgagatttaatttgcatcacaatcatatagataaataaggcggtcaaagcaaaatcaactacagttagattaatactaagcacactaccaatcaatgaacccacaatattagaaacggtccaaaaaaggagtgaccagtgctcaacttggcgagcatcattaggggtccagtgtttatctgttgcaaattttaaatagtttacagcgtagttttcgtcattcaaggaaagagcaaatgtaaaaatcgaactacgactctcaccttgtagatatttcgataaacttgaacctagcaatgcgtatcttaactctaggaagaagagcatcaaaacaatcgtcaggataggagcgttaactgttaacatttgcgcaatcaaaaattgggccccacctgaaaaaataactaaggaaactaatccagtgagtaacgtattgaaaccagcagcatgtaatagaattccacatgctagcccaatcggcgtgtaacttaaacaaagtggccacgctactttaaatgtttctttccagcgcgcctccgttttaatttgtttcaaagtttgtcctccaaaaaaactagatataaaaagaatacattaattttttgcaaagcatacgaattaattctaacacgctaaataaaattttaatagtaaagccactaaatatccctctttaatcgcgtcctttaactaaaccaatcagctatagaacgccccaaacgaacaaaaatattagcttttttcacatcttgagttggtttcaatttcacatgtacacctttaccattttcaaggaattggtcctgattgcctttaacattcgccgtcgcaattaccttagaatgtttaatgggtgctttttgttttggatcatttaatttaattgcattgacatgcagtttttcgctccgaccttttggaacccagtaatctagcggttgggccagttctaatttaacatccgcaactttagctgagttaattttaacagaggcttgattctttaaattggaacttaaaacggccaacttagtcatcaacgcattccaaatcgttttggtatctgtgaaacgtcgattttcactggaacctaatacgacactgattactcggtgacctttaattttaccggtggcagaaaaatcctctccggctttatctgatgtacctgtttttagaccatcaatttggtattttgtttcatactgttccgcgccttttagtagttcattatgattagtaatttcaagttcttcttttccagtattaaaagttgttttttggattttagtgatatttagaatctcagggaattcttttaagacatgggaaattacgattgccatatctttagcagacatttcgttttctatatttccagatgtgccagggtacttttcactaccaacttgactttctaataatcccgccgcgttgtacaattttgcatctttaataccccattttttcacgattgcccgcatttcattgacaaatttttccgaagttcctgcttgggcttttcctaaagctaaaattgccgcgttagctgaataaattaatgatgcatctaacaagttacgcactgtgtaggtttgattggaagaaagcggaacgttggttaattcactgttgttactaacttcttccaagctcttattgatagacactttttgattccaatgcatttggccctctttaacgctcttcatgatgaggtaagctgccacaatcttcgacattgaggcaatcggacgaactgtgttttcatccttgctatatagaatctggcctgtgttttcatcaactgcaatcgctgatttagcagtgatattactagtggttgcttcaataactgattcgttattttcagcagctagcgctggcgcaaaactcgtcatcatcattaaaaacgcaatcagcatcgtgtataattttttcataatctaactcctgatccgaataaaaaagactgttccaaaaggaagtctatttttcaatgtggtaactaacaagttaatctcttaaaatttagtcgccacaattgaagcgtagctctttgacgaatagctctaaaccatccttcaaatctttcatcacagtctttacatcttttaaattttctatggtaagtccttacttaccggttgatgcaatggcaactgaatcacaaagctcgttcgcttatcgttcgaatgagcttcgatagtaccattatgcatttcaacgatgctttgagcaatagctaatccaagtcctgttcctccagtggctttggaacgggaaccttccactcgataaaagcggtcaaaaagcttgccaagggcctcagcaggtactttttcaccatcgttagcaacttcaaaaattaccgtatcattaatttgtttggcactcaaaaaaatatttttaccaccattaccatatttcaaggcattggttatcaaattgttgaacacccgaccaattttttcggcatccccggtaatttctaaatctttcggcgtacatttagaagtaatcacaaaatgcttctgcttagcttccagttcaaaactagctgctaactgttgaagcatagaatccacattaatcgtattaattgtcaaatggggattagattgactaaccttggtatattcaaaaaggtcctctaccagtgatttcatctgaattgattttaaatatgctgtatgcgtatattttaaaatgtcatcttcatttttaaattgacgatcttcaattaaccttagataaccaataattgaggttaatggcgtacgtaaatcatgcgatacattggtaattaaatcatctttagattgcttaagcgctcgctcttcttccatggagctaatgacactgtcaaccagtgagttcacactatccaccactcgttgatggtctccacttaattcaaatggaatacgatgatcaaaatgaccattagcaatgtaatgtaattcggcaataatatgacgtaactgcatttgcttgtaacgtcgttctaagcgccaataaagtacccctgcatcagccaaaaacatgattaaaataaaaatcttttggtagctccaaatctgtacgccgccaattgtaattgaatttttaaccataaagaccgcgtttgacaaagctggattcgactttaaggcactatcaattaagataaaaactgataaattgagtaatagtaaaagaattaccgtaataactccttcaccaaacaattcatatttttcacgccccgttaacttcatttgaatctctcctagtgcgcgactactttatatccaacgccccagacggtttcaataaccttttcaccacccgtagcttcttcaatcttgtcgcgtaaatgactaacgtgtaccattactgttttagctgaaatcacactctcctgttgccaaacacgttcaaaaatctcatctgctgagaacacccggttaggatggctagctaaaagatataaaataccgaattcaagtgctgttaattgcacatcttttccagctaaagtccgaacttcatgtgaatcactgttgatgattaatgaaccaatgtccaaaatttctggttcatcagctgtcatatctttttcactacgccgtagaagtgattttacacgagccatgacttctagtggattgaaaggtttagctacgtaatcatccgctccagtcaagagccccttaatcttgtccatatcatctgttttagcagacaacattaagattggtaaggatgaatccttacgcacttcccgaaccacttgcatcccgtccatttccggcatcataatgtctaaaatcattaagctaatatccggatcggtacgtaatttagacaaagcttcttttccattgtaagcagatactggttcgtaaccttcatttttaatataaatgtctaataattcaacaatttctttatcatcgtcaacaactaaaattttcattggtgaatctcccctttttactgtcttttttaccagtctagcaaatttcgttcaaaacacccgttactagggctggattttattaatctttaagaaaaccttccattttcagcagtttttcttttaattcaacccctgcccgataatttccaattttcccatctttacgaatcacgcggtgacaaggaatgactagcaaaatcggattatgtgccactgcactagcaacggctcgaatggctttaggtgtttctgctagttctgctagttccgtataattaacccctcgaccgtacgtaattttcgttaatgttttccatatcttttgttgaaactgggttccattacttagatcaattgctaaattaaattcttggcgacggttttcaagatattctttgatttgacgtacagcttcgatatttgatttttcatcttcaattaattcaattgcttgataaaactgatttacttcctttaacgtttggttcggtgagccgacaaaagctaagccctttttagtcgatgccacatagtacgttgcatctttcacttgaaatttagaataatatagtttcatagcatcaccctccttctaattttaacctgtaatcatcgtaaaataaaaaaagttaatagccaaggacgaatccttgaccattaactcttaaagtttttaattattcaataccaaattgaatatttatttactatttatggtagttaggagcaattttagtcatttgaacatcatgtggatgggattccactaaaccagcgttcgtaatttgcacgaactgtgctttttcagccaatccagcaatggtagctgcgcccacgtaacccattccagaacggagtccaccaagcatttggaagatgattgtggcaactgaacccttatattgtacccgcgcttcaattccttctggaaccagcttattggcttcatttacgccaccttggaagtaacgatcagctgaacctttttccatggccccaaccgaacccattcctcgataggctttgtatttcttaccattatcttcaatgattgaaccaggggtttcgtctgtaccagaaagcatgctaccaagcattactgcatctccacccgcaactagggctttaacgatatcaccagagaacttaattcccccatcagcaataatcttcttgccatattcacgagctacattagctgcatcgtagatagcggtaatttgtggtaccccaactccggcaactacccgagttgtacaaattgaaccaggtccaatcccaactttcacaacatcaacaccagcgtcaaacaatgctcttgttccatccgcagttgcgacgtttccagcaatcaacgtttgctttggaaaatgttcgcgaatttctgctaccttacgaagtactcctgctgagtgtccgtgagctgtgtcaattacgatagcgtcagcaccagcatcgattaaaccttgagcacgttcaaaagtatcactagttacacctacagcagccgctactaatagacgaccttggtcatctacagctgcatgcggattgtcttccagatttacatccgcattttttacgattgaaacttcggaagcttgttgtccagcactcatatttttatgaatgacacccaagccaccttgacgagccattgagatacccattgcagattcagtaactgtatccattcctgcactaataatcggaatattaagcttaatgttatcagctaattgagttgaaacatcagcctcattcggtaatacatggctttcgcctggaattaataaaacatcatcaaaagttaaaccttgttttgtaaacttgttatcccaattgctcatcattctctcccttttctttaactaaaatatgccaccaacgatatgaaactttcgtctaagataccaccgtccgccgaatgctgcaaccgctaatattgcatatccgtagaatggaagggttggattgataacaggtggtagcattccaaagctagtatagaagataatccaaaggactacggcaattacgacgattcccgcttgtttccatacggaagggcgctttttactagatcctaagactttgtagatataacccataccaatcccaccgactgctgacgttaaaataattgctagcaatcctgaaggacctggtgtgctagtaatcgtcttgggctcaattaacatcatgattgcgtacattgcagcaaacagagcggcaaaaattaaaccattatctaaagctctaatccacatattgttattttgggcttcaattttagctttcttaggcccttctacaatttcatttaatcgttgggttggggtaccaaataattgtttagctgttttaccagttttttgagcttctaataaccgagtttcagtatcaatcaaagcttcgctacgttgttcatcgttaagcttgctttctttaagctcttttcgtaaacgatacataaaatctgcattacgtttagttaattcttgttttttaggttcattttcatgatgggcaactgaactactttgcttgccctcattacgtggttcttcagtcataatctatttactcctcgtttgatttatattagacattaaagcggaattcgataatatcgccatcttgcacaaggtattccttaccttcaagacgtaaacgtcccgcttcacgaacaccttgcatactgccatacttgtctaaatcatcaaatgaaactgtttcagcccgaataaatccacgttcaaaatcagaatgaattacaccagctgtttgaggagccgtcattcccttcttaaacgtccatgcccgtgtttcttttccgcccgccgtgaagaaggtttggagacctaaaaggttgtatgaggcttgaattagacggtttaagcctggttcagtaattccttctgcttcaagaaattccgctttttcgtcatcttctaattcagcgatttcttgttcggtttcagctgaaatacccaaaacttgcgcatcagggtcttcttgagcaacataatctttaatttctttgaagtacttggaagcttcaggatcggccatatcgtcttctgcaatattagccacataaagtacgggcttagtagttagcaagaaaagtcctttaacaataggcatttctgattcatcaaaatcgattgtacgggctgctttaccagcttccaaaactggatgtaatttttccagtaccgctaattcagctactgcatctttatcgcgtcccttagccgcacgctgtaccttagtcaaacgtttttcaacactttccaagtcagctagactcaattccaagttgatggtttcgatatcttcgatgggatcaactttacctgaaacagttgtgatattgtcgtcgtcaaaggctcgaacaacgtgaacaattgcatccacttggcgaatattttcaaggaatttatttccaagtccttcacccttacttgcacccttaacaatccctgcaatatcggtaaattcaaaggttgtgtgcacaatctttttagcaggaataatttcttgaatccgatctagacgttggtctggtacttctaccatcccgacgtttggatcgattgtagcaaacggatagttagccatttcggctcccgcctttgtaattgcgttaaataacgttgacttaccgacgttcggaagtccaacaataccagctgttaatgccattttaattccactttcctttcaaaactgcgtgttcttctctatatattatcaaaaattaggggtcgttaacagaccgttcagagccaaagttgcgctttcatcaccatcaataaagaaatctcgtatattacagttctattttttgattttagttagtaaaaaagaggcactacgatttgcaacttaaaattggcttatcataatccctcttacaacttattcagcgtgttcaacgaccttcttcaattttcgttcaaattcacgacgaggcaacatcacaatgtggccacatccctcgcatttaatcttaatgtccatccctacccggatgatttcccaagtattagagccacacggatgacttttcttcatctgaacaatatcatgtaattcatattccattactaaatcctccttagtctaaagaaatattcaaaacatccaaaatccgatcaagttcttggattgaatcataattgatttcaattttacctttttgttttgattttgctacaaccagtgcgcgcgtcccaaagcgttcccccaattgattttcaagttctcgaataaaaggtgatttgttctttcgtttttgtttttgagctgcttctcgatctttatccaaattaaatttagttacgatttcttctaattgacgaaccgttaatccctcttcgaccgtccgttgggcaagtttctctaaagcctgaggttgcttaattgccaacaatgttcgtgcttgtcccattgaaattcgtccctcttggagcatcaatttaacgcccgttggcagtcctaataaacgtaaataattagcaatataaggccgactcttacctaatcgttccgaaacctgtgcttgagttaaatttaactctttaatcattgcttggtaagcttctgcttcttctagcggactaagatcctcccgttgtaaattttcaataattgctgcttccatagtggcttcatcagaaaagttccgaataattgctggaacttgttctaaaccggctaacatactcgcccggtagcgtcgctcgccagcaataatttcataacgttctaatgcagcaattggttgacgtagaatcaaaggttgatagataccagatttttttatcgatttagccaattcttcaagtcgatctttatcaaagatatgccgcggttgaaatggattaggataaatcttagtaatatcgatcatctgatacgttgcgtcattttgtgttttcaattgttcatttaatactttcttacccatcatgataaccttctatttcttgccaattggatctttacctggtgttccaggtttacgtggatacttatttggtgtttgctttttcttttctaccactactaaatggcgttcgtcaccagtcacaggtagcgcaaaatccttgtccacgatcagcttaccgcctaaaatggcaatggccattttcccatctgaaagttcttgttcagtattggccgcttttaaggcaataaaaaatccgttttgtttaaccaacgggatacacaactcactcaagacactcaaacgtgctacggcccgagccgttacaatttcaaatttttcacgataaacggactttttagcaccaaaagtttctgctcggtcatgtaccaaagtcacatcggttaattctaattggtccaccaacgttttcaaaaaagtgattcgtttattcaatgaatcaacaatcgtgacttttagtgatgggaaaagaatcttcatcggtaaagaaggaaatcccgcccctgctcctacatcacatagttcagctcctgatttaaaatattcaggcgcctctaataggggggtgactgaatcataaaaatgcttgaggtacacttcattttcttcagtaattgccgttaaattaacatgttcattggtttcaactaacattttgtagtaggtagcaaactgggccatttgatggtcactaatttgatatcccttatcttctaaagcctttttaaattcttctggggtcatgtctgttctccttgtgaaacattaattgtttcatatcttatttccactttaactaattagtaaagatttagcaatattgtgaacacatttgtagtctaaagttggtcgtattaactagcaggaggatttagttttgactttagttatccaaaaaatcaatacttatagacccgaacactacaaattactattagatgccgacccctcccttagaagcattgccacctatttatctcgaagtaccgcgttcgaattgaccgaccagcaccagcccgtgggaataattgttgtcatgcctaccgaaccgctaaccgctgaaattatgaacgtggccgtcaaacctgaattccaagaccaataccttgggagtcgcttaattcaatttgtggtagattattttaacgaagaccctgattttacggctctaacgattaaaactggaacaactagctttaagcaactttatctataccaaaaattaggcttccgctgttctgaaattttaaccgattattttaaaaatccagaaatttatccaaatgatatttacgaaaataaaatgctattacgcgacgcaatcttgttaaaacgagccttaaaggtttaaaaaaatcccatgatgattggcttaggaaaaactaagctttaatcatcatgggacttttattcatttaaattaagcattcatctttttaacttcttcaataaaccaggcattgaaggcgtcggcatcaatatcaacacacacttcagcgttggtctttccatcgtgataagctcctcggatatctgcaacggtttcaccattcgccggtccttcagtaactacgtcaatccaatatgggatggtcttatacatttcgggttttagtaagtatgccaacgtattaacatcatgcattgggataccaccttcatttccctcgtaatagtggttaaaaatggctcccagcatttctccagccttacctaaggattttactgtgtctaacgtagattgcgttagaagagctttcatcgttacatctaggccaaccattactactggaatgccactcttatataaaatttcagcagcgtggggatcagtaaagacgttgaattctgcagcacttgtcatatttcccatgccaattgctccacccatggccacaattttttcgatcttggtttttacatcgggatgttcagtaagtagtactgcaatgttagtatacgatcctgtgggtaccaaaacgattggttcatcgttagccataatagtgtgatataaaacatccactgcattgttaactggaatgttagtgggttctgcaccaaaatcgtaaccaggcattccagattcgccgtgaactcgagcagcatcttcaaatggtttaatcaaaggttgttctgccccaccagcaaccggaatatcagcgttgaagaattttactaacttcatcgcgttcttagtagttttatcaaccgtaacattcccagccaccgtcgtaattaattctaattcgatttcaggattattgatggccacggaaatcgcagctgcatcatcaattcctggatctgtatccataataatttttgttgtcattttcttacctccagcttttatgaaagcgtcctcattaccattctaaaaaagaatgcacgttacgtccattctttttcactatctatttaaattaattaataattaaatgttaaaaaggttaccagacgaacacacctacaaatccagctgatagtaatgaaactaaaataccggaaagaagcatgtagccaacattcttagaaattgcatcatttctttcacgatcgacaagacccttgaaagcaccgatgatcattcctgtggttgagaagttagcaaatgaagttaagaatacagtcaatgttgcagcaaaatgaggtgcgaaatctttcatcttaccagttacatcacccataactacaaattcattggtaactaacttggtacccatatattgagccatttggaaagcatgactagggtcgaaacctaataaccatgcaaatgggaacattacacaaccaaggatgttttctagagaaagaactgggttaatcttacctagtaaagcatcaatcaaagcagccaaagcaacaaaggcaattacgttagctgtgataattaaaatcaaacgaccagcgcccaaaattgagtcgcccaagaatgagaaaaatggttcgcgttcaggcttcttgctaactgtttcttcagcaaccccttcagaaccagattcgatggtatctgtactttcgccagaggcacttccgccaatcttagcaattgtatcttcttctggtgttacagtaactggattcaaaactgttgtaacaataattgaattaacaatgttaattggaacagcagcgatgatatattgacccggcatcataagtaagtatgaacctaaaattgatgcagtaacacaactcattgacatcatggcaattgtaaccaaacgttgtgacttcatgttacgaagttgtaaacctgaaacagcaagagcttcagtgttacctaaaaacatcatttctacagcgaagaatgattcaaacttaggttgacgggtaatgaatgatagacccttaccaacccacttgataatccatggaaggataccaatgtaagttaaaatatcaaacaatggaacaatcatcaaaattgggagcaatgcacttgtaacaaagttcattgatttaacgtgtacccaatcaggcaacgcaaattcaatacctttataagaaacatcaaccaaagctttaaagccatcagcagcggctttaaccccgttaataccaacagacgagttaactaagaaccaagctaacagaatgttgatcactaccataataccaaccgacgcccagttgatatgtttacggtcttttgaaaatagaacagcgacgcctagaaatacaataataccaataatatttattgctaaaaacatgccgaaatctccctctatgatccaaattatgtaacagacgttgtaataataataactactaaatattagtctgtaaatacaaaatataaagatttttaaaaggttttcgtaaatcatccactacatcttgtggtgcggtccaaaatatgttaaaacgatttacctacagtttccagaacgctttgactgctttttgtaaatcgcttacagaagttactttttggtagtttttccaatgcctgggaaataaatttaaataacgggatgtgacaaatctttgatccattaacaaaatattacctcgatctcgtcgagttcgaattaatctccccgctgattgaagaacgtggttcattccaggtaattgatatgcgtactcaaatccatgaccatttttttcgtcaaaatattctttcagcaaatttctttccgtactcaagcccggtaatcctacacttacaatccctacaccaattagttgctcgttaattaaatcaattccttctgaaaagagtccgcctaacaccgcaaaaccaactaatgttcccgatttttcggtccgaaaagcatctaaaaatgctgtccgctcttccatactcatctggctagtttgcaggtgaacttcaatttcaggatgcatttcctgaaatgcatccgcaatttgatttaaataggtataggatggtccaaaaattaagtagttccccgtcttggcttccaccagagttgcgattgaagcgatgatgttaggtaaatttctttggcgcgccgcatatctagtatcaatataactagtaattaaaagattttgctgtttttcttcgaatggtgaagccatctgtaagatcaagccttccgtacttcccaaagtttcttgatagtattcaacgggcgataacgtagcagaaaagaaaatcgccccgcgccctttttttaatgaggcatctaaataaggactgggatctagaatctgttcttcgatttttatatcatcttcgggattttgaattaaaattcgataactttcatcaaaatattcactgatcttaatgtatttattgttggcaaaaaacaaatccaaaatggtactggtcaaatcgttatcgggttgtttaggcagccattcccggaccacttcattgaagttcaacatggctttttccagcccgtctagtggactatattccaccatgtaatcttctgtttgatttttaaatgcttgatgaatcaactcaaattcattatctaattgggtcaatctacgtttaacttgtttcgagtccacgtcagtggttgaggattcaaaaagttcttgtacttgaattaccaaagcttgctctaccaccgctgaatacattgctctagaacgcgacaccaaattatgagcctcatcaattaaaaagaaattactttggtcttcaattgtaaaaaagcgctggagatacaccatgggatcaaacaaataattgtaatctccaataattaagtcacaaaataaagataaatctaatgaaaattcgaaaggatctaacatatacttcttcgcatacgtttgaataacagctttgtcgaacttgtcttcattttctaaggcgtcctctatcccatcctttactcgatcataatacccaatcatgtatggattttcttctggtttcatatccacttcttcaggaaatataattcgatctttagctgtaattgtaatggatttaattctcaatccttgattagccatcaattcgatagcttcttcggcgacgtgctgagtactttgcttagccgtcaaatagaaaatccgttcaataacttcctcacccagggctttaatggtcggaaacatcgttgaaactgtttttcccgttccggtcggagcttctacgaagaggcgttgtttagttaaaatagttttgtaaactgcaactgctaggtctcgttgtccatttcgatactctggaaatggaaattctaatttgcgcgctgcctggttacgttcagtacgccaatcattgcgtagcttaatccacttttcgtattgtctaaccaaatcatcaaaaaattcggtcagttctgttcgggtaaatgtttgtcttttttcaatcacttcgtcggttggacgttgataataagtcagttgaatggtcactttgtcgaagtctaagtcttgcgtcaaaatcgctccgtaaacttttgcttggctccaatacaatgtcttagtattctcacttaactcttcaaaagtaggatccgaagttttaatctcttcgataaacaggtcatcgtcaataactactccatccgcacgaccttcaattgtaaaagtttccccatccatttcaacggctcgtttaacgtagtattctttttcgtaattttcatcacgttgcttttgcaatttacgatggatgcgggcaccctctaatgcagtattttgactattcatcgtcgcgttcaagtcacccgtacgcaaaataaattcaactagttgtcgaattcctatcttagttacgctcattcaactcacctctatttcttaactttttcattatcccataaaaccttttctagaatttctattttaaaaacgtatttatggtatgtaatcaaaatctaggaggatttttatgcataccaaattacttctatccagtatgaccgttttaatgggattaactttcagcattcatagtgtttcagcccatggtttttcaccaaaagtagctccactttcagattcaccttcagctgaagttcaccacccatcgtcccagccctcttctgcttcatctaattcttttactgcaattcagacggtattagcacaacatatgggtcagccttacctttggggagctactggacccacagccttcgattgttcgggcttaactcaatacacctttaaaaaagctctaaatcttaatttaaatcgtaccgccgaacaacaatttaaccaatttcgccatgttagccatgatcaagtccgtcctggagatttaattttcttttcttataatcatgggcaatccattgatcacgttggcatcattgttgaaggtcaaaacatgatggtagatgctcaaaatcggggcgttattcgtgaatgttatctagttccttggtggcgagggtacatcgctggatatgatcgagtaattgaataaataaaaaaagaattccagctggaattcttttttattaaccaaaatgacgcttccaccaaccttgtttaggttgatcaagaattttttggttcttttcggctaattcgtcaattttttgttccaatttgacgttttcttcatggtaactttgattctgttctaagactttcgtcaaaagttccttaagatcagccatatccttgctttgcgaagcaataaagcgtttcatggattcatcgataacagctggtgtgttttctgatcctgtaacttcatcggtatcttcgccatctttactactgttgtcattcatccctagcgttgcctgtacagcttgctttagcgtatgacgatcaccaagtagttcgttcatcttagcaagaatttccatatcctcttcagaataaatacgacgtccacggccatcatgttgaaacttatgtccgctacgttccatttccttagcccaattacctaaggtggcaagactaccaattcgttctattttttcaacaacatctgaacctgtaacatattcatctgctataatatcttttgccattttttcacccactttgaacttaattttactacataatttgtaacaattgaagtacgatttcagttaaatagcaacctacctatcaacataattgctacttttcgccccaaaacgggtcaattgaaataaaatcaatcctaaaaattcaaaaccaaagattaaccaagctaaaggagcgtaactctgggttcccattattccggctaatggagaagctaaagcgccaataatattcattaataaacctaagacggctgaagccgctccagcatttgttcttccacctagactcatagccatggatgttgccaccgtattaacaactcccacgcaaaagaccacaataaacaggggaataattactaagatcgccattggacgtaatagtaagctcccaactaataatactcccgcaaacatgccaccaattaacccgccatttaagatatcgctatccttgatttgctctggtaggtagcctggaagattgttaccaagaataattcccagtccgttaattgcatataatagactaaattgccctactgtcatgtggaaataagtttgaaatacaaatgaagaagcagaaatatagctaaataatgcaccaaaaatcagcccttgcgttaaagcgattaaaataaattgtcgtttaccaaacattgctcccaaccctttgaaagtttgaccaagcgtcaagacttcattgttggttaccttcaacgtttcgggtaaggtacataatacccccaccatcactaaaattccgatcacaaataatagtacaaaaatcccttgccattggacaatagaaagtaatgctcctccaataattggcgcaataattggaaaagcaccatttaccgccattaacattgcataaaatttagttaattcatgtccattaaacaaatcacgtgccaccgctcttgagagcacttgcccggttgagcccgctagcccttgaattaagcgaattccaataaacagatagatattggtagtaaaaattagcatcaatgaggtcaccgcatataatccaaatccgactactaatggaactcgtcgtccaatccgatcactaatagggcctacaattaactgtccaaccgctaacccgatcaaacaaaatgtgatgctcaattgtaaggtagaagctgatgagtgaaaagctcgttgcatttcaggtagacccggcaaatacatatccattgataaaggacctgtcgcactaacaactcccataaaaaatacaagccaccattttcttacagttgatatcttttcattcataacctcagatctccttttttaaaacttcaaattcaagtgtaacgaaaattagttcaaaatcacacatcaaattttggtatccttaatatgttacaattgctagttgacacataaaatcgaggtaatcatgaataacaaagaaaaaacaaactatcaaggcaaaaaaaaattcggtaaaaaacctagtaaccatcaaaaacaagaccgtcggaagaatttttacaataatccccgtaaatcttctgacatcaagattggtgacgaaattccacttaaaattaaacgtttgggtataaatggtgaaggaattggttactaccagcgtactatctgtttcatcaaaggtgcgcttcctggtgaaaaggtcgtagcatccattaccgatgttcatccccgttttatcaatggtgaagtaagtaaaatcaaaaaaatcagtcccgatcgggtaaaacccattgacgcatatgctggaggagtcggtggattcgaacttgaacatttagcctatcctgctcaacttgaatttaagcgtgatgttattcgacaatcactaactaaattcagacccgaaggctacaaacgtttcgaacttctaccaaccatcggaatggaaaaaccccttgaatatcgtaataaggctcaattccaagtccgtcgtttagatggtaaggtagcggctggactctataaggaaggtactcatgatctagtagatttaccaacttgtagcgttcaacaccctttaacgatggaaatcattcgaattgcggttgaattattcgaaaaatacaacgtaagtatctatgatgaacaaactcatacgggaagcctaaaaacgatcgtagtacgtgttgctgacgcaactaaagaaactcaagtagtctttattactaatacgccagaattagaacatgtagacgaaattattgatgaattagcagctcaattccctgaaattgtttccttcatgcaaaatcttaaccctagtcgcgaatcattaatctggggtgataagactttaaacctgcgtggtaaggataccattcgagaagaattggatggtctatcattcaacctatccgcacgcgctttcttccaacttaatcctaagcaaacttctgtactttatgctgaaactcgtaaagccctcgagttgtctcctgatgacaatcttgttgatgcttactctggagttggaaccattggactttcacttgctgctcaagctaaggaagtccgtggaatggataacattgaatcagcgattgaagatgctaatgaaaatgcaaaaattaatggcatcgaaaacgctcactatgaatttggtacagctgagaaagttcttccaaaatggctacatgccggttttaaaccgaactcaattgtggtcgatccacctcgcgttggtttagataataaattaatcaccgcaattttggaatcagcacctgaacatttcacatatgtttcatgtaatccttccactttagctcgtgatttagttcgtatcgttgaaaaatacgatgtcgaatacattcaatctatcgatatgttccctcaaacggctcgtgtggaagcagtagttaagttaaaacgtaaataaaaagttgtgacaaaaggctgagtttaagcgtatagctatgagaactcaaactaccttttgtcgcaacttttttaatttatccatttatttttcttagcaacttcaatggcttcaagtcggttatgaacccctaacttactaaaaattgctgataaataattacggaccgttccctcagataaaaacagtttttgagccattactttagttgcatccccactaactgcagcctttaaaactgacatttcacgctcggataaaggatttttatttgatgataaggctgtgactactaattctgggtcatacactgtgcgtcccatcatcactttattgatagtttcaatcaaatcatcacttggactatcttttaataaatatccagctacttctacttcaactgctttttcaaaataagtcttttgagcaaatgtagttaaaataattactttagtagcaagttgcttgtcatgtaaaacttctgcaacttctagtcccgacatcatgggcatttcaatatctaaaattgccacatccggttggagtcgttggatttctgctaatgcgtgttttccattggttgccgatcctaaaacttctaaattatcttctaaatttaatagctgacttaatgcagtatttaacatgctttggtcttctgcgagatataaagttatcatcattactcctctggtaagttaaaggaaacttgcgttcctattttattttgttgaatatcaaattcgccatgtttagcacgcatccttgcttgcataccggaaatcccattagaaccctgtcgaataaaagtttgcgcatgtccatcatcttgcacttcaattcgatagcgaccctcagcatgcataaaacgaatctgaactgtacgggcttgggcatgacgaataatgttcgtgattgcttcaataattacagctgcaaattcattttgaacttcagttggccaatttatagcttcgttttcaccttcagtcatcataaagatattagcatccgtcagattcttactctgaataaataaagcttcacttaatgattgttgatgtaaatcgttaacgatttgacggacaagctgcaaatttgctcgacttgtagtcgcaatatcttctagttcacgtcccacttgatccgaacctttttctaacaatttcttagctaattctgttttaactgtaatcatcgaaaagctttgtcctaaagtatcatgtaagtcccgagcaattcgttcccgttcaccccgacggacaatggtttctaagcgtcggttatcttgacgcatttttcgacggtagcgaatcgaaactgcaaaagcatatgacatgattggtgaaataattggaaacgccagacccataatatttccaaatattcccccaccagtattagtagtaatttgcgtaggaaataatccgataacttctactagcccgataattaaaatagtgtaatacgccccaaaaaaagccataacatattttttaggtctccccacaatcaaaaatgctacttgccaagctgtgaaaaccatcatatagaaattaaaattaaaaatggtaaaaattcccgtgattaagatttctaatggaatggaaactttttgccattctggtttttcggctgcccaaatataatctgctaagaaccctagacacataactatccaaaaagcatccgttgccgatttaattggtaaataaagcgaaatattatatggcatatataataaccagatataatattcccatttcacatttctaaaattccatttatttttaaccacgagccaatctaccctttcgtcgtgtgatgattgttcccactgtcattacggcgaccaatccaactatccaaacccctagaccctgaacgtcattccagttaattttagcattattcactgtgctactaatcatatcgttcaaaaaataggttggtaatttattaccaatattttgaacccaccgcggtaaaatttgaattggccaccaaagtccgcttaaaatagccactggaaatgtaattaagtttcctaaaattgttagagtttcttgtcgtttaacatgtgatatggcaattccaagtagtaacagaggtatttgacctaaccaaactagtcctaatatagttacccattgcatagtacttaaatcaacatgattgatcagaatcgccgtcgttcctaaaataacaatcgtaaagatgttcatcatcaaactccaaaaacaaatcgaaatataataatgatttaaattacgattagtaatctttaaaagcgtaattaatccttggttacggtctcgctccataaaattgccaacgcccataatggcagtaattaaaatactgtaaaccatcatgctccccatatattctgcactaaacgttttaatttggactctattaatttgcgtaaataggatgtaaaaggccgtgggcatcagcaatgaaaagaacacgaagccataattccgaaaaatcaatctttttccatcaaatttcagttgttcaatcatcttctgcattgtttttttctcctcgagtaatagtttgaaaaatattttctagtgaagcatcaatgatgttcaaatgttgaatttcctctaaatatggtactaagtctcttaacgttgcatctccattagtactactaatttttattttatttccattttgctcaatcgcttgaacttgagttagttttctaaaaatagatcctttacgtttagtttcaaaactaatctgggtggttaaatattgtttctgaagttcattcaaagtaccatcaaactcaatttttccatcttttaagattaaaatctgatcagctgtctgttggatttcttctaaataatgactcgtaattaatatcgtttttccttcatttttcattcgatcaacgttaatccaaaaatcttggcgagcattaacatccattcctacggtaggctcgtcgagaaaaatcaaacttgcattgctaactaaagtcattgcaaaggtaactcgtcgcaactgtccacccgataaatcgttcaaataatgatgcgctaaatcacttaaatttaattcttttaataccgtttggggagctttaggattaggatattgagctgctacctccgccaaaatttccccaactttcacgccaggtaactttaagtcaccttgaaacattgatgcgactgattgactcatccctggacgatgtcctaaaattgatactttcatatttgtttttaataagcctaataagattcttaaaagcgtggtttttccggctccattttcaccaattaaaccaacaactttccccggctggacttcaaagcttacgtcttgtaaaacttgttgattgccgtagttgaattttaagttatttacgatgattgcatttgtcataattattcctccatgcttatatcatagaaaataccttttcgtttccctagtactgcttgtcaccaaaaaatatgacaaatgtcatactttctaagaacttcttaagttcacttaactccaatggattttcatagactttaagctccaacatctgaataataataggaaaatagtgacaaaatattctttggaggaccccaatggaacaatacattattaatttcgtaaacgactttggttatttaggaattattttgctaattacactggagaacgtctttccccccatcccttcagaagtgattttgacttttgccggcttcattaccctttcttccaaacttaccgtctggggtagtgtccttgcagcaacgattggagcggtgattggggcagtgattctatatattattggaagttatctaaccgtcgaacgcttaggacgtctaatcagtagccgccttggtaaaatcctacgtttaaaacatagcgacgttaccaaaactcataatttctttgtcaaacatggttccaaaacgattttctttggccgttttgttcccgtcattcggagcttaatttctttaccagcgggtatgactagaatgccttggaaaatctttgttttattaactacactgggaacgttgatttggaatgttgtactcattctgcttggtcgactggcaggtgaggcttggtccgaagtatcagctacaatcgactcctactcaagcttagttttaatcgttctgatcgtgctgtttgctggatcagctatcgtctactatttcaaacgaattcgagtaaaatcctaacctagtaatcgctttcatgttagaattaacctaacttattcagctaggaggaatcattatgcacaagcatctacctactaagcgtcaaaaacaacgtcttgctccagtggtggctttcgaaattaccggtctttttattgctttaaaagatattattactgccaaaaaattccgtcatgggtcgcgtggtctgtggttagctttagtatttattcaacctatcggaccttggctttacttctggttaggacaagctaaaacggattaattggtcctaggaagaagatgaatttttttgaaaactgctgacgtcaaaagacgtttcttttggcttgtcatatctattattttaaattcggcggccaacgctttatccattgctacggatttaggtagcgccgtctggacgggttctgcagtgaatctctcacattgggtagctcataccaccagccctgcaattgctaatcacgtgatgggaacggttttagttttatacggagtttcagtagcttttttgaccatgcttttatcgcgccatttggattgggctcgttttgcccgcaacattttatttgttgtaccgtttagttatctcgtccaatggttcacccctttttggagtgatactttaaaaatcagccagttgcaagctaattttcaacatccttggcagcttttaacttctgttattctggatattattggtttattgggcgtggctgtagctgtttcactctatcaacgggcaaatttgattatgcatcccaacgatgatctttcctacattctacgttttagatatcttcacggtttagcctcagtttcacaatgggctagttatgtcccaccacttatcatcaccgctcttagctgctttgctaacggcggccgattatggtcatttggtttcgggaccgtttgggcctttgttacccaaggttacgttcaaggttggtccgatcaacacgtagttccaacctttagacatcatttttcatttcaaagtccaaaaaagctttgataaaagggcgcatcccatcgtgaatgctaacaaccttttaccaaagcttttttatttattcaatgttttaatgatttttttagcaacaattgttgcatattgcttggaaccatcaggattaggatggacataatctccatagaaccaaccagattgatttttagaaggtgtaaaccagtcaattactgtcaaattcttgtattgcttagtcgctttatctaacgtcttatttaccgatccttcccatgtcttcgttggaacatggacattaacccagaaaatatgacgtttagaacctaccgcatcttcgactgctttaacgtccttatcagaaatcggaccattggcccctaaattaattaggacattatcacttaaagttttttgacgttttaattcggcaataataccaggcgcttcatcaacctgccgtccaacttttgatgacatataagctgttggaaaaatttcctgcaagtctgctcccgtatcttcgagaacggaatcccccactccggttaatggagttacggcagcaaatttcatttcttgatcagtcaactgatactttttagcgatttctttttcttgtttcgttagtttagcctttttttgcttcgttttggctgcactagtttccttttgtttttccaaagcttctttgtttttcttgtcggcctctttactatttttagctaatttagtttgtaatccatctgttttttgaaccactttttctggtgaagtaactgcaccaaatagagcaattaaaaccactaaaacagctggaattgccaagtatcgacgccattgtaagttagatttcaaatcaaaaatctttttcactagtgcaaaagtttgccgatagtcaaatttagctagtggaatttcaatataacgataagaaagttcactaattactaagatgattactagtggtgctaaagtgtttaaaactggatgagccgcaatattagtaactttttgttcgtaaaaaatcattactggtagttgatacatataaatcccataagaccgacttcccaaccatttgaatacaggattagtcaacaggcgattccacataaacgacggatgagcgatgatcgcaatcattaaaacggccagaatagagaatatgaaaattccaccataatatggcgttgcggtggtccccggcatagtaaagaatgtaattcccatgactaggattaatataccacccagtatattagcaattaaattagttctcgcatttagcgcttttttcaagcgagtcgacggccaaataaaagctaacgctgctccaatcaaaaatggtgcaactcgtgtgtctgaaccataataaactcgattaactgtatctggatgatagagaatggtcatcagcatcgatgaaatgatactaagagaaaatagaattccactcgcttgaacacgacgttctccaaaaattttcaataatactatcagtatcaatggccaaataaagtagtactgggccaacaccgataaataccataaatgcgtgaatggtgattctccattgtagcgatcaaaataggactgcccattatttacaagccaccagttatacacaaatactaaattagtccagataatatttctaatatgggatagtaggttttgcgcaaaaagtgtcatataggctgtacttgttaccaaaaccataactagggtcggatatagtcgacgtaatcgccgaatgtaaaaagaacccaattttatttttccggttcgatcccattcttgtataaaaatatctgtaatcagataacccgaaacggcaaaaaagatgggaacccccaaatatcctccaggaacggtaaaagacatcagatggtagaaaataactcctagcaatgccatcactcgtagtccatcgaagcctgtgatatagcgtcgttctcctacattctttcgctcaatctcaatagaagtcccatgtaagtcagatcttctcatcttttcgcacctctaacatttaaataaaccaaattttattccccacaatctattcctcggaatacccaaatgctgcgtattcttaaacttgttaaagtaccggctttagacccttatctatgcgttatttataatgttctcactttttttattaaaagttcaaaaagcacttaattattatgacacaactttaacattattgctgttataaataacgaagttactaaatgaatttaaattaacgattacctaattcacttttcgcgcttaaattttgatgataagattaatttaactttgtcttaaggagtgattattttgagaaaaattgcagtatattgtggggcagccgccggcaacaatccaacctacgctaacagcgcccgtaagttaggtaaatggatggctagtaataatattggcttagtttacggaggtgggcaatttggtttgatgggaatcatcgccaaaactgtcattgaaaatggtggtcatgtcgatggtattattcctgaaaatttagcagcacggggcgcaagctatcaagctgtctcaaatctccaagtagtcaaagatatgtcaattcgtaagcaattaatgatggatatggcagatggtttcattgccttacctggaggtcccggcacgttggaggaaatttctgaagtattttcttggtctttaattggtgacaataataagccatgtgtccttttcaatactaatcactactatgataatcttcaaaacatgtatgatcatatggtggtcgaaggttttcttaccagtcaagctcggcaaaagctccttttcagtgattccgttgaacaaattgcagaatttatggacacctatgttccaccaaaaattcgtgaatattaacccgatgatgcgcatctagcgcatttttttgtacaaaattcctatttcagcatcattacaattaaaccaatggtaataattattcgaattataaaatgattccaattgatattgaaaaaaattagttgtccattaattaatgccactggtaacgccaatatcaatccgataattcccagccacggttgaaccaacgtcaaaatcatcaaggcacctacaataacatttaaagctgtaatccatgtttcaacttgtaccccaatcctgtaggcactaaaaatcaaaaaaccgccgtataacatcgttaatataattccaatcatatgtagcataggggtccactccttattatttctaatagaaaacgctttctgaaactattgtaacaatttatctagcatattggcgaaaaactttgtagttgacattctactcccttatctatatagttagttacacaagtaattaagtgattcaggaggaggatttttatgattaatcaaccaatcgttagcgtttcgggtttacgtaaaacttacggggggaaaaacgaaaaacaatacgaggcattaaaaggaattgattttaatgttgaacaaggcgaatttgtcggaatcatgggggcttccggctctggtaaaacaactttgctcaatatgcttgctaccttagaccaacctactagtggtaaggtcatgattaatagtcaagatgttactacccttaaaggcgacaaaattgcggatttccgggcaaatgaaattggatttattttccaagattttaatttgctagaaacgctaacagctgaagaaaatattgcgcttcctctatcacttcaaggggttaaaaaaagtgccattaaccaagcggttactgctgtggctgaaacactatccattcaagaccttttaaagaagtatcctacagaactttctggtggacaaaagcaacgagtagcagctgcccgtggaattgtccacaaaccagcactgttattaggagatgaaccaactggagcacttgattctaatagtgctcgtgagttgcttgaacttctaaccgacattaatcaaaaacaaaacgtttctgttttactcgttactcatgatcccttttcagctagtttctgtaatcggattttgttcattaaagatggcgttattggtcaagaaatacgtcgcaacggagtttcacggactgagttttaccaagatattcttgaaaaactcggaacttttgaacaataggaggcgaacacatgctatctagactcgcactctcaaatatcaaaaatcgattacgggactacatcgttctcttgaccggccttgtaatgtcttccgctatcttttatatgtttgccaacttggcaaccaacgaaagctttattaaaagtaatactacttttagattcgctgttcctgttttttattttggtgaggtattactcgtaattatcactttagtttacgtcatgtacgctaattcattcttattaaacatgagacttcacgattatggtttatttatgatgttaggagccaaaaaacgtcgtgtaggaacattgatggttttcgaaactttagtcgttggtgccattgctaccgcaatcggtttactgctgggaattggtttaacagggggactttctaagttactattctcacaccttggaattgcacttcatcattttaacccattctattttaaagcagtactgacaaccattgttttatacttagtactttttatcattgccgcaatttttaatcttcaatcattaattcgtactccggtactcaaattgcttaaacaaaatgatacagttaacaaaattaaggctcatggaattgggctttactttgcgggaatatttggagtaattttaattggaattggttactatgctctagctcaaattgcaactttccaattaacttctattccaattgctctagttactatcgtgctaggtagttatttaattttccactcaagcatgatccttattatcgaacgtcttaagaaatctaattgggcacgtcgtaaattaaacaactttactttatctcaaattatgttccgcgttcaggattacactaagattttaacaattacgtccctcttgttcgccttagcgttaggggccattaccgtgggctctgcgttcaatcgtcaaatcgattcattggctaaaagtaatagttcctatactattgctattaacaatccaacagctaaagagcaaggtttgatcgaacaattatctgatcgtacagtcgttaaatatgaccaaaagtttagtggtaaccacgttatctataatgaagatcaatttgctcaacatccatataagattgttgaaacaactcaaagtaagtctggtactatgaatacgtataaaaacgttccagtttctgtcagcaagcttaaaaaagaagttagcagccaatttgattttgtaagtttaggtggttctgttttagacacggctcctaaattctatgccacaaacgattttaataaaattaacgccaaaaaaggttctgttagtttaattacggttaaaagtattgctgagaaccgtactgttttagagaagttaaaccatctccaacttaaagcttatccaacaatggatgaaaccggcattggtgctggtactttccctgccttcttaatgattagtgggatctatggtggactagaatttatcggctacttcttaggaattgcattcctagcaatgctagcaagttgcttgatgttcaagattctttctggaactcaacaagaccggattcgttataacttgctaactaaggttggtactcgtcgttctctactaaaccaaagtatcaatcgtgaaatctttgtgctatttgcacttccaggtatcctaggaattattgatgtactctttggactccaaatgtttaagagcttcttcaataataatccttatcaaaacatccaatatccaatcataatttttgttgtactatatctgttgtattacttcctaacaacttggttatataaattaatcgtattgcctaaaaagaaataaaaaaaaaggtgaacccatagaggtttacctttttttatatcctagtattcaattatttaacttgatgtccttcagccacatactggtccatatcattcttaggaaccatgctaccacccgtcgcccaaacaatatggctagcattttccattggataatcctgttccaattgagcttgaacgtcatctaaaatcgtaaaaccagaagcagctgatggttcaacatccacattttctgagtcatgcaattctgcaacattcttcatcatcttttgatcatcaaaagtttgaattccatataataatgtatccatcatcttaccagcaattctagatggacgcccaacagcaagaccgtcagccttagttactccatcgattccagcatcataaactgaaatttgatcatttaagccagtcatcattcctagcgaaactgatggaatatgagttggctccgcaaaaattggatgaacgttttcgccaataatcttctttagaccaaaggctacaccactagggctaccacctactccagcaggtagatatacaaataatggatgttcttcatcaactttgatattttgagccttcaattgagcttgaagacgaactgcagcaaccgaatatcccaagaataaatcgtacgacccttcatcatcgatgaagtaagccataggatctgcttcagcagatttacgtgcttctgtaatagcatgagtgaaattgtcgttatattcaacaacattaacgcccttttcacgtaacatatccttcttccattgagcggcatcgctcgacatatgtacgctagttctaaaacctagtttgcaagctacaataccaatcgatagtccaagatttcccgttgagcccacgacaattccatattgtccaaataaatccttgaagcgtggttcatttaatttagcataattatcaccatatacaatttcaccgtgtttcattgctactttttcggcaaatttcaacacttcgtagattccaccacgtgacttaattgagcccgaaattggtagataattatcagccttaagatacaaatcacccttaacttggttttgagcttcggcatttaaaacagccttcatcttatccattttgagcaaaggggattctaaaattccatgtgttggtaaagtttctgggaatgctacctcaaaataaggtgcaaaccgttgaaaacgagcttcagcatcgaagatatgttcaactccaaccggtaattcagcttcctttttataattcaggttcttccaaaaaattggttcgtaagcttgcatctgcttaatcgctggatattttttgcttagagcatcaacatcaatcataattttttatctcctcgttattgtattcacatttagtatacaacgcctagaatgctttgctaacccctatttcaagaattaatgtattcattcacaaattcttctttagttttaatttctttaccagagttaacaatcatcgcgtgaaaatttttccattcttcatcggttaaattaattgctgcttcaacttcttttttggcctgttcatacttagatggtaatggatgtcccatccactcaaaaattcgttggctatatttatcagctataaaacctgcatggtcaaatgcatacatcatcaaatagtccgccgtttctggaccaatccccaccaaagccaataattctttacgtaggcgcaacgttggcaatgctccaattttttcgattgaaaactgatatttttgtgcccaagttaggacattttggatggtttgcgattttcgcgtataaaaaccgctgggacggatttgaatttgtaacgcttcattactaagccgcaaaatccgatgtggatcaaaattaaagttgttctttaaattcattaaacttggtgcgacattgacccaacttgtattttggactaggatgccaccataaactacttcccatggcgattcttgccactcttccaaccacggctgtttacccattttctgatacatcatcttgtaaatcgttggaatttccatgtcagtctcctccctctatgtattataattcttttccaaaaaaacactataaatctaaaattagcgttagaatatacttggaaacaactataagtttttaaggagaatttaaatatatgattgaaaaagcttgtacaactgttctagtcggaaaaaatgcttcaattgacggctcaactatggttgcccgcaatgacgatacatttttaccactagctccacatcgtttttatatgcatcccgctgaaacaggtgtagacgaaaccatcgtttcatctcaaaatggtttcacagccaaattaccagctaacggatatcgccatagtgccgttcctaatattgatcccgataaagatggtatttacgacgaaagtggttttaatgaaaaaaacgtagccatgagtgctacggaaagtgtttacggtaacccaaatactttggcttacgatcctttggttcctaatggtttagctgaagatacaatgcctacgatggtcctaccatacatcgattctgctcgagaaggcgttgaatatttaggaaaattaatcgctaaatatggttcacctgaaggtaacggtgtgatttttagtgacaaaaatgatgtttggtacatggaaattgttactggtcatcattgggtagctcaacgaattcctgatgattcttatgcggtagctgccaaccaagttgccattcaacaagtcgatttcgatgatccagataatttcatgtggtcagatggcatccaagaatttgttgaagaacatcatttaaaccttgatcacgaaggctggaatttccgtcgtattttcggtacagatacagaaaaagaccgtcattacaacactcctcgtgtttggtatggccaacattatttgaatccagagattgaacaagacccacaatcttcagacttaccatttattcgtcaagctagccgtaaaatcaccgtggaagatgtcggtgccattttaagttcacactataacgaaactaagtacgatccatttggtcatggtgctgacgctgatcgattgaagttccgtccaatttcaatgaaccgtactcaaaattctcacgtacttcaaattcgtaatgatgtccccgaagatcgttcagctatcttctggctaaacttcggggttccagcattcagcccttacgtacctttcttcaataatgcgaccgatacagatcctagctatcgtgctactaaagctactatgaaccttgatgacgcttactggatgtatcgtgccgttggctcagtagttgaaggacactacagtaacttcatccaaaccaacgttgattacgtcaccgcctcaaaagagttccttcgtggacgcgttgctgaaattgatgctcaagctgctaatctacaaggcgatgcgctaactcaattcttaacagaagccaaccatgctactgttaaagcaatgaaagaacgtacgatgaaccatttcaacgatttgttagcttctggtttgttattatcaaaactaacctttaacatggataaaaatctctaatataaaaaatgatgaacgctaaaccttaaagtttagcgttcatcattttttgttttataagatgtattcaccagctatgcgcaccagcgacgtcatttcttttttagctgttttgagccccacattcccccgaccatctggatgattatcactcagaatggatatcaaatagagatgtccattaacttcgacagccccaatcgaattcataatccaacttccagataaggtccagccgtttttattggctaagaaattaggtgtatcgctaaagcccttgattccccactgttgttttgaattaacttgaaacatctctgaaataatataattgcgacctgtacgactaattttgctcgactttacaaaaagatgtttcaataatttaatgtaatcttcggaactaactgttgaaagccaccacttactactagcttgactatgatccatccccagtctagcaaaagtagcatttaatccgctaactccaccaatttttttaaatatagccgtagcatcagcattactactctgacgaatcattcccgcaactaattttttatcactagctgttaatttagcatcttgatggagtaatccaattaaaattggaactttaacggtacttgctgtatacatttggctaatcttgccttgactccaacgatacgtttttgcttggcgacatcataaatggtaaaatcaaaattttcattttttaaatcagtattcgtttggcttaacttgccaacttttttatccatatatttactaaatcctgaatttggtgcttgtttggttgtaatgtgcgttgtagtctcagagcgcgggtgtaaaagatggtgcacttctacaatcaataatgtgatcgaaaatataattagcaaaaatcccgtcaaccagattttccctttgcgatttaatcgcctaccgtgaaatgtcactcatctatacccctttaaaattatatatgccagttcgattataaccagcaattaacgtctatacaatgtttattttttgtaacattttcccaaatttaaataatttaattactggtattaaatttacttgaaaaaacaaaaaaaactggaataagcataattaatacgcttactccagtttttaaaaggtgaatttataggccttaggattttactttaacatttgttctgcagttttcttgagctctgcatcgttcatattttcccactttttggcctccgcaatggtcttcatcgtatcatgaccgttgtcatccattacatgattccacattgcgtctcttaatggcgtttgatcgttactccagtcaaatacctctgtcatcttttgatcaagaagttctgtctttaatgttgttgccatattaaaagcctccaaaatgcgtgggtgaacatcatctgataataatgatgtcgttcatttttgttgcaccccacgactatgttataacaccagttttaaattttgttaaataaaaagccacagcttttttatagttgtccccaaattctatcttttaaggacgctatatttctgccgtgacttttaaactttagttattttctgtaaagataggttcgtgaattgtttctacgtattgcgctgcttttggtgttacatacatgtcttcaccatctttttgaaatagcttagccgcacttaatttgtccattgcttgtcgaacagttgcttcatccaaaccttgttttacgtaattaatttttagatgttgggctttcccagctgcattagtaaattctaagtctaatagtttcatagttactcctccaaaatttttaagcttgatatatgaatgccaattggtttatttagttttgattacttttctaagataactttttcagttgttgtaatttgagcatcagttacattatcagtagacaccatttcaagtgttttagccagttccgttacttgttcggcagtgactgtttgcgccacgtttgaaaaagctcttcgaacccctttttcatgatctgggccttccattgtgatactgattcctgttttcaaccaagttttaaccatgttttcatcctcatttcttatcatttaatataagtgtcgcgacgacttacacttactaataacgaatcaaaattaaaaatgtaaactaaatctattaaattttttatatcttatttggataaactactatgttaagctttgatgacttttaatagctaacatagattttaagttaatctccttttataattagtttattagaacaataagtatcaatgtctaccaaatcaaaggagaaaatatttattatgagtagcgtaattggaactttacttattatcgctattgcggggttacagtacctctgcagtcgtattaaatataaatattcaggtgcagtaattccaattttatttgcgggcagtatgctgtactattatttaattgctcaaaaagctagtttctgggcctttttaattattctcgttgtgggagaaattctcctcctcagcatttgggacaatcaatatcaaaaaaatgaacaaaagaccgaacagacccaccttcgtaaaaaatagccctcctctgtatcacacctatagttcttactttatgtctctagcttcctggatcatcttgcatataaaacaacatttattgtaggaaagtgtgcttaaatttgagtttaagcggttggcaacctttttattgaaacttaacttaatttggttgataatatagaaagaaatttaacaacatcaccatgtttgtttaaacacggcgctggttatggaggaaaataatggacattaatcttgattttccgttaggatcatcaattataaatttggtattgagtcatcgaaacctcgccaccaaagaaattcgcaaacttggactttatccggggcaagatttaatcctggtagagctattgcgcaaagataaccgctcacaaaatgagctggttaaagcgctctgtgtggatcattcaacgattgctaaatctgtaaaaagattactaaaagctgaaataattaatgctcataaatctactgaagataagcgggtaaccataattagtttgaccgttaaaggtaaggcgttagctattcaggccgctaaggtatggaacgatgtggaaaaaaccgcttttaaagatttttcgccagcagatattaaagagtttatgcaatattcacaacatatagcaaaaaattttacggatagaagtttagaactaaatgatagataattttaattgcatctctttctagctgatacccagagttcatcttaaaaataaaagcaatcattacctccgcatttttaaaatgttggaaacgatatgatttcacgtgaaacctatctaatttctcacatatgggggatcatttggttgacagcgttttcagttcgaggtatattgtaggtgtactagaacataggtttcccagcccataattgctctagtatgggtattgaatgagcctttcaagtaccctattagtgctcatatacccttcttacccaaagagtggatctgcttccccagatctactttttttgttgctttagaatttatatttgtgcgtaatttaatcagactgaattatttaaaaaaatcatcattataccctattaaccattgacagcgtttccaacttgaagtatattatagataatctaatggatgtaggtaactccctaagccgattatcatccattagatattcttaccctagttgcgtagtacttcccgaagcacagctttcccaaactacgtgacgtaatattcttacccaaagaaacacccatctacttccctagatgggtgtttcgctgtctctactgctttattcctcacttctttccgagttcctaaccttaatctaggacgtttaaggttattacttcatttattaaaaacttcctacgccctaaacaatcaaaaagacgtataagaggtttgggttatcctctactacgtctttgtaataattattatccaaccactttttcgccatttaggtatgtcttatctagcttcatttctcggtctaacacaataaaatcagcatcgcggcctggtaaaatgtgtccacatttgcccccaattcctgcgctatcggccgcatttgcggtggccatctgtatagcttgttcaggagtaactacattccaatcaaccacgttctttatggcgtcttttaatagtaagatactgcctgctaaactatgactgctatctttcaaacgagccgtaccgttttgcacaataactggaaattctcctaaaatatagtcgccatctggcattaaaccagctttcatacagtccgtaactaaagttaccttactaggagttttggcatccagtagaatcttgactacatatggattcacatggtgcccatcacaaattaattcatctgttacaccttgtaagcttagagctgcacctgccataccaggttcgcgatgatctaatccactcatcccattaaatgtgtgagtgaacatggttgccccagcctcaacacaagccttggcctgttcaaaggttgcatcactgtgtcctaaagctaccgtaaccccttcagagctaatttgagccgtaaattctactgcaccatcacgctctggtgcaatcgaaattttacgaatcatgccattagctgctgcttgccattcgtgaaattcttcaatactagggttttcgaagtatttcggattttgagcccctttatgtttttcagtataatatggtccttcaaagtgaataccttgaactttagccccttcaaaatgatcaaggttcttgctaattacttgaaccacttctttcaactgttctgaactagccgttaaagtcgttggcagccacgaagttaccccacattttagtagcccattagccatggcctcaattccttcagcacttgcatccgtcacatcgtgattcaacaagccatgaatatgggtatccactagcccaggagctatccatttatcactatattctacgatatctccatctggttgatttttttgatatctactaaatttaccatcaacaacttggagataacctcccatttctacattactacctaaaaagaatttttctgcatgaatataatattccaaacttctcgctcctatccttcaaaatcgtgaattgttacaccttttactactcggttaactgtccccgttgctgaaggagtgtccggtgtattcttaaccttgattgatgatagtaaggagatcgtttgagcaaacattacatcagggaaggccatataaccatctgggatagaatcaactccattagcaaaattaaagttgctacctgtaaagttgtgggctgattgaacaccgatgcccataacgactggtgcaatctcgtctcctgccacttcttcaagaatatccacatcatactgacgagtgtaagcattgttgctaacgaaatcaaagaggagtgtcttactattaacaaatgacttaggaccgtgtcggaagcccatcgaagtatcaaaaacggtcactttttgtccagctgttagttccaaaaccttcaattgtgcttcacgagttagtccacccaatgcaccagatcccagataaacgattcgttcaaaatcggtatcaaccaatttctgaatatcatcaacccggtcaatcacttcatgacccattttactgatggcgttaacataagtttctttctgttcatcagaatgttgagcatcgaaaactaataacgttgtgagtaacatgcagctaaaactaccagtcattgcaaaacctttatcattggaacgtgctggttgcattagaactaagtttttatcatcttcttgggcatggagcgcaagtttaccttctggagcacatgtaatggttatttgatatagatgtttaacgtacttttcagctatatctaccgttgctacactttcggggctgttaccacttcttgcaaacgaaactaaaatcgttggtgtatctttttcaagatattgtttaggggtagaaacaattttagttgtatcgattgcttcaaaacggaaatggtttcgatcaccattttcagttaagtatggcatcgctgtatctccaacataagctgaagaaccagcaccggtaaaaataactcgtaccggttcgttgaattcgttttcaatctttcctaaaaaagcatcaattgcttgcttcttttcttggtagattttaaaagtttctaaccatagttctggttcttgttgtatttcacgagttgttataacagcacccatttgggttaattcattatcagtcattttgtacatagtgggaattctcctctcatccatcaatgcttatacttaatgttataaacaaattggtcaccacgagcgctactaatggtatattcaatgatttcatttttatgattgtatgttgttcgacggagcatgaatcctggtgaattaggtgcaatctttaataaatcggcatctttatcactaataatccctactgaaagcatttcatctgctagacgaactttttcaccatagtcttctagaaaaacattatagagcgcacgttgtttcgtttctaactcataaattgacagattctcaaatttttcagcaggaaggtaagttcgatcaatcatcattggcattccatccgccaaacggagccgtttgagtttaacaatgggatctccaacattaattcttagcttgccactaaaatattcatcggctttacgctctgacatttctatgatctttgtttccggtttgcgaccaagcgatttcatttgttctgtaaaactatattcatcaccaattttagtcgtatcatccatccaacttgctacaaaagtccccttaccatgctggcggtaaatatacccaatgttttctagttcacttaaggcttcgcgaaccgtattacggctcacttcatactttctcataatttcacgttcggataataatttgtcatttggtttatagttatttttaatttgttttcttaattcatcaacaagctgtccatatacaggttgcttttcattatagttaaatcccatggtttgattaccacactttctaaatctgattcataatttatatgatataccaaatttaggttttgagtggcaattaatgttaagctttaccgattatgccaagtgctgatagcacaactgccacgataatcacgataaagatagcttttgttgaagtcattctctttcgaccaagcatccaatagattgctccaacaattaaagcagggaccaattttggcatgatcatatcaatcttatcttgtaagttaacggtcatcttccctaaatgtgctacgaaaatcacatgagtattaaccatagtagctgctaaagcacctacgacataaaccccaagtaacgttgctgcatccgtcaaagcatttagctgtccttgcatttcattaactaaacttaccccttgtttgtaggcaaatttcagttgaatccagcggaaccacataataacgaagttaactaacatccataaaatagcacctacaacgttaccttgaaccgccatattagcagcaattgctcccataatagcaggtaccaaagcggcaaaaattgaatcaccaattgcggcaaaaggtcccattaaaccagctttaattcccgcaacggtttcaagtgaattaacaccttctttttcttcaatcgccatatcaattcctgaaataatagtattaaagaagttacttgtattaaagaattgattttgcattttcatcatttttttcagctcgggagtatggtcaccatacattttacggagctggggaagaattaagtaaagataaccggatccttgcatacgttcgtaattccatccaacttggttgaataagaggctacggatattcatttgcttaaagtctttatcagttaatttataattagtcttattagagtttgtcgccatgaatctcaccatcctgttcatctaaatctgttgcaccagcattttgtttaggttgtgcagctactaaattgctttctttaacggaacgattgtactgcattgcagctagcgcaaaaccaatcaaagcaattcctaacattggaaggtttgcgaaaacggtcgtgaactttgcattcattccggcaatagttgtgccaagtagggttacattgccataaattgttgaaagcattgctgtgataacaaaacctaaaattaagtatggccaatgtttttttactggtagataacgaagcaagatagcaaaaccaacggcaggaagaagcgcacccgcagttgcaagaccgttactcaaccaagctaagttggtattcatataatctacagccgtacgtacaaatggaccaccaaacgcaagtgctagaaatacaggaataccacgtgataatgtccatggaagatatccataaaggtaatttctttctataccactgtaattttcttcgtcaattaatttatcaattctgtgttggaagaaagtattagcgaaacgtgcaacaatatcagtctgaatcatcaaactagcaaccggaacccctaaagctgcaaccgcaacttcgggtttcatacccgtcccaatcgcaaaagccgtagccataactgttcctgagtttgcatcaattttagaagctcctccaaaagttcctaccccaagcacggttaattgcaaactaccaccaatgatcaaacccgttttaagatcacccattactaaaccggcaataatcccggcccagattggttgacttaaactagtttggagcgttaactcatccataatctggtacattgaataaattgttaaaataattacttgccatattgcaatacctgaacccataagaacgcctccttcttattttttagtatcaaattttttcaaaattgccataaagtcattggcttgatcaccaggaaccatttgctgagtgattttaattcctttttcatgtagtgccttaaatgcatctacatcgtcttgcactacattaatagaattagtgatttgagtcgtctcatccgtctgtgacatatttccgacgttaatcgtttctaacttcactccgtcgttaaccaagtccaataatacttgtggccgtttaaccacaataaatactttttgcgaatcatagccgccacgcttaatatgatcagcagctaccttttcagagagcacactcaaatcaataccagctggtcgagctaatttcaaacccgatttttcaatatcgcttgcagccactttgtcatcaatcaccataattcttgttacaccgagcttcgttgtccacaaattggctacttgtccatggattagccgtccatcaattcgtaccgctgaaattgtcatactactcactcctttgttttctcaaaactatgctaataaaattactgtttctaagccttttagttgatatgggatggttaatacatcatgctcaatccattccggtttaaccgctaactcttgaagttttgctccctcatggaagtaaagtttccaatcttgttgttgcttagttttagataaatgaatttgaatttgtttttgatcatcaatcgtgaaatttgaaagtacaatttgatttgaagacgccgtaatcttagttccagccatatcaactacgtaatctatatccgtagttttatttaaaataagttttaaaagcttagctttaattgaataatattgcgattcccaaccatatttagggtcggtattcattggtaaaattaccgtccgcccattgataatggtcatcactggtcctaatttttcagccttcgcactatatgcacttgataaaatttcaactttatttgcattctcataagcgattttgtaataatcccccgtatgttgaagcatggtgactcgcggattctcaatttgatcaatgaccattccatcaatttgttcgtaagattgataattggttcgagcccgcttaatttccaatttttctgcgtcaattaatgttctcaacgttggtctttcgaacagaatttgaacactttcaccatctaaaaacatgacattttttttaagcaatgctgtgatttgttcatcatttagattgttaaaaaattggccactaaccgctaacacttcgttttcaaaattgcttgtattcgtccatttttccggtttacatgccactcctaaactacccaaaagtgataaccaactgtactctttaggtaagagttcctctgggttttcgcctctagtagtctggaggttaaacgaggcatcctgagatactaaaacttttactccatcgagttgttccaaattcaatcgatgttgagttcccaaattcattaagtctttggattctgccaataattcagcatagccatacgtttcatcgattccattccccatcatatcgaataaattcagcaaaattcccgtagcgcccagcatttgtgtactttccaattgtaatttagtaaacattcttgatttaacaaatggcgaatacatataactttccagctcaggatatacgtctgaatttttgccaactaattccgtagtcactctggagtaacgttcaaaatctcgtgaatactgtaaaggagaaacttcgttatatgctggtaaatgtggtcgactaactcgtaaatgcgtaccagataaactatcaaatagaccgtcccaatcgcgtccttcaactgcatgccattcgggaaaagaactcatcaaacccaaccttgtggtgggagaaattctagcgaccgtcttttggattaaacgggcaacttttttcatttctactcgcgcaacactgagatatattttgcgttcaagcgtgggttcccctggttgtaagagctttttgacaaattcagtacgggttaccttacgtcctaatttttccgaataaatcttcatatgccgctcacaaaaacatgcaagtttgattggtgtgtgattgtaatgtctaaaatcatcttccagccataattccttaggttggagtttggcatattcaccgtagatatcagcaatatattcaacccacctaggatctgcaggacaagcgatggattcagcgtgttgacctcgataatcaaccatcgttccaaatcccaattctggactaactttttgtccacgatcgctatgcatcagcgttgtccatggatttaaacttgttgttatgtccatctctgctagccgtttagaaacctttgctaccgtaggcaaccaatgcgttctaacttgatcgatggtaagatgcccttggtttaactcttctgggttaataaaaaagactacattgtcaattcgagcttcctgacaaaatttaattaacttcttcgctcgttcttcattccagttaaaaggatcaattgcgaatcttaatgaatattgataggtttctgccatattttttacccgtttagttttgcatttacgtcaataattccattttgtgcttcgtcaattacagattgtttacttacttccattcccatcattacttgattggcaaaaccaatcaccatgggaagattcaaaccactaactacttcaagttctggatgttcagccatcaaacgaaccacaacattggagggggttccacctagtaaatcaaccgccaccattgtcttttcgttattggggttgtcattgataaactgctctgcttcggcctgtaaatcttctggaccttgattaggttgaagcccaatagccttcatgttatcaatatgtccaagaatcatctccgcactagctaaagtctcaaccgccatatttccgtgactcattaacaataatctcatgtaacattcctccatccctgggtttgtaattatattgtatacgcttacaaatacctgtaaataaacagctgatattactaccagctcaattcatatcataactggttggtaccagtttgtcaaccaagttatagacgctaaaaatgcctttttcatgggatttttatactaaatttttcgcgtttatattttggtatagatggtataaatttacaattttcaccagtatcatcactatttattaaaaattcttcatagacattttcaaatcggtttgttcaataaattagtaataaaaaaactttgattttttacaaatcaaagtttcgattatattaaattaccttcatctaaattaattaaaaaaggagcaatcggatcattttgttcgttgtataacgttaagattggcgcattactatatccatatcgagcttgcgtagtcccgttaggaaactcaacaacgacttgatcatccttaatctttgctggaatcgattgccaaacaccattaactaatccttcaatatggcaattttgggtagcatgtatgtgttggacgcctttaaatttaaggtggacttgattcttatctttaataattcgattaaaaaccggcgtacttgaatacgttgtccctgccagaattttccctagccgtgtgccagcaattcttttcataaccggatgaggattatataattcccctgtatccgttatagaaactaggtgaactgccgctaaagtttgactcactttcagcatttgttgcctaatttctgcccaagcattccgaagcacgttagcatactttggtaactgaataatatagaatggcaacgaatagtcttggaaaactctgcgccaatcgttgataatctccctcaataacacatcatacaaatgacgcgtttcaatatctgtctcaccttgataccaaaccacttgatcgaatgaataatttttaatctttaataccattgctttaaataaggtacctggttttaaataactatctggcgttaccggtggtggccaaggcgtttgtccaacaatattaagagccattcccaatgggacactaggattatctttcataaatttatacattcgtcgattattacgctgaactttttgacgatataatttcacctcttcttcaaactctcggttgggcttattttgcagttgtttctcaaatggacgaacgatttcatccatcaactgtggttggctagtaagcgtcgatttcgacaaccaagttgcagctaatgccccgtccttagtacaacaaacaaccccgattggtagctgaggatcttcttcggccatccgcttaactgcataaaaagccattgccgaaatgtgtccgagattagtagcctttaactgatgccagtgggtagtttttgattgatagacttccacttgtccattttggaaataaaatgcaggctgcggaacgttataataggcgatattgttcaatgtgaaatgatttacctcagtctcaaaatcctggtcttgtgccatccgaaagcctacattggattgtccagccattaaaatcactcgaccaaaacgcaccttttttagtaagatttgttcccgatcatctgcaatttgaacttcaaatgaacttctagtatcaatcactggatcaaagcgacatgtccaccgaccatcgcgttttacaattgcacgctttatatctgaagcaatttttacttttacggttgaacccgctcttcccgcaccgctaatctgaaatgattttcccgccggcaaaaccatattatccgaaaaaatttgatcaacatgtaattcgaaactttccatgcttaacctctctgaataaaaaggccagaccctcctaactaacagattggatctgacattttatattacctatctttttagtcttacttaaattcaatcccgtattcaaacgtatgactttcaccagcctcaagaaggttattgcctttcttgttattccagtccgttggctggtcgctagcttgatctggaagccctgcaaatggttcaatgcaaataaacggttgagtttcatgttccatcgcccatagcgttagatatgggaattgtttgatgttcaatttaacttcatgagcagtttgattagaatgaagggtcacattttcaagcttcttagcattcaaaataataagtccatcatcaaacatttcgtgatttaaagctaattcactagcttggattgatggatatggagcttcagttccatcgcggaaaggaatgggacccactccgagtcttttaatttgtttttgttttggtccaaatgttaggcgatagtcttcaaaaacaccatcatcatcaattggaagattaaaagctgggtgagatcctaaagcatatggcatcatccgatggtcattattaatcacccgatatccaatcaaaagctggttctgatctaatttgtattcaacttgaagggtaaaatcaaatgggaacatttcctttgttttagcatttgactttaactctaacatcactcgattttctgcttgattaactttctgccaatcaaaatctcgtgcaaatccatgttggggcattcggtatgtcttaccatctactacatattcatcgttatttgacttaccaatcgctggaaatagaataggtgcatgtttcttccaagcatcaccattccaaatatagtcgtagccactttcgtttccaataacatgagtcaattgagctcccatattatcaatttcaacttcgagacgatcgttttttaactttatcatatgaatttagttccccttccttatttttgtacagtcttagcatgattcattttcattaaaatgtaaaggctttctttggctttgttcgacaattttaaccttcatctgaacttcaacaccttttgtaattagttcgaaactgttatgatagaattctgttagaaattttgttccacctatgacacttctcccattctttgggttcctttggtcatagtaaaattagtgacgtttacgttataaaggagaatttaatatgtctagttctaaaataaacacccgtgagattgttttatctgccatgattgccgctctttatgtggcaattacatttgtcttttctgctattagctttggaccaattcagtttcgcttagctgaaatgttaaactgcttagtgatttatgacaaacgctatatctggggcatttcgttgggagtcttaatttccaatatgcaatcatctttaggaattatcgatattacatggggaaccctcacaactatcgttacgctttcaattgtttacttagtcattcgtaaatttagcgatacgaaggtaaagatgggcatctgtgttgccatcactactgttctaatgggctttttagttgctattgagctcgcctatgttttgaaagttccatttttctatacttggggaacggttagtcttggagaactaggcgtgatgctaatcggcgccgtcgtaatttatctacttggagaaaatgttaatctatccctatctgctcgcagatagtaaaatctactaccaaaccaaataactacaagcctttaaaataggttcaaattaaatactttagtataatttatgtataaagtaagccttttagtcgaaacggagggactcagcatgcatcaattatctaaagtatttttgattaccttagcatctttttcactggttggattagctggttgtgcagacaaaaaatcagccacagcaccagctactgaaaaagcttcttcacctgcccgcgtccatgaagttcaacgtacaaacgccactactatcgctctggctacttaccatttgatgaaatccaatggccaacttgaaaagcttaacgatgacatcgaacccagcgcaagaaatgttgtagaagatactgataataaaaaaattgctttcgatgcgggaactgagcaaaatgattattttgaacaaaaagcccatattactatcgataacaacaaggtgctttatacaaccaaacaagataataccagtgtcgataacctctataaaaagtattccaaaacagttagtttccagcattttttagatgaatttgaaattcaagaccatgacgaagattttgacgactaaaaaagctgaatcaagaaaagttcttgattcagctttttatagtacctgatttattcaaacaaatttttagagttaatcttctaaattctcaactaccactttacccatcatatggtttccctcaaccagcttatgcgcctgttttaggttctccacgttaattggggataattgcttagtcaaggttgaaatcagttctccagcatctaataaacgagcaatttcgtccaaatatacatgctgagtctccatgtctggtgtttcatagtaggacttcgtgtacatccattcccaagcaaaagtaacccgtttacgttttagtgctttcaaatctaccggttcatggttttgagtgattgaagctatcctgccattcggtttaatcagctcgaccatttcatcccaatgagcatcaatattgtttaactctaaaatatagtctacgtattgatgacctaagttacgaacttcatcaatcaagttattacgatgattaacggtttcgtcggcgccatgttttagacaccattcaatagtttctggacgagaagccgaggcgatcacatgtaaaccggctttttgggctaattgggttgcaatggaacctacgccaccagccccattaataattagaatcgacttatcggcgtttccttgcacatcctctcgatcaatttctaattgttcaaataatgcttcccacgccgttaatgaagtcaatggcatcgcagctgcttcagcattgctaagcttttcgggggcatgtcccaccacccgttcatctactagctgatattcactatcgcttccggcccgtttgaatgaaccagcataaaacacacggtcaccaatttcaaaatatccagctgatgcgcctttagctaccacagttccaactgcatcccaaccaatcactttaggttcgtctaaagtttcagttccatttttacgcaccgccacatcgattggatttactgatactgcatcgattttaaccagtagatcgcgtccttcaggctgaggaaccgccgtttcaaaacgaaacaaacttgcttcttcatcgatgggtaaatgtttttgaaatccaattgaccacattgttttattcattttggtaccattcccttctttaaaataatgttatttattttataattgtacctcgaaaattgttaaaacttgttactaagtaattgaaaatagccatgttaactaaattttgatgccatcaccattccgtaacttttaatcttgttgttgtcgttgcaaaataccttcagtaatatcagcaatcgttatttcatccattttttgaaaagcactttgctgtatttcagcgtatgcatcatctaatacgtcttgaatactgccaccaacaacacactgtggatttgtcttagggtcgatatgcaagaggttatgatccatattcaccgccttataaacatctaaaatactaatctcactcggacgagcatttaacgctgggctagcactccctacttttgtcgtaattagtcccgcacttcgtaaatccgacatcaaatttcttacagtactagcattggattcaatactatctgcaatggtcttacttgataagtcgccgtccttataaataattaagtacgtcaaaatatggattgcatcgcttaacttataggaatacttcatcgttaccacctaatttaaaatttcgttaatagcctctggtaaactagttaattcccgacccaaaacttttactaaactatctgattgatgactgagagagccatcttcaattggagcctgaaacgaagtaaatagtgccgcagtatctgcatctaggcctcccgcttgaagttgagcttgataggcatccctcgaaacctgcttaacttcaaaattatttccagttgctgtttgaagggctgcgcccaaatcagcatacgaacgaattttaccagcaaattcatagatagcatctggattttctagcgtaattacctttgcagcagcctcagcatactcacgttctaaagcccatccagcttgttgatctgtccagtaggttgctgtttgattattagcaccactttgtaaaaagcccatttcattttgaagataccagttgttgcgtagaaatgagtgtttgattccttgttcttcaattagtttctcagttaatcgatggtcgtttgctaaagcactggttgatgcttgagcatttggaaaactagtataagctacaaaatcaacacccgcatttttaattgctgttacaacattttggtgttgagttcctcgagctactttaccacctggttgcgaagaaataaagagcactcgatcaatccctttcagagctttttccattgtagttacatcatcgtaatcaccttgacgaatttctacacctttaggaagtagcttttgacctttttctagatttctaacaatggcgattacgttgtcggttcctactaaatcaattaatttttttatcgcgatttgtccaaagtttcctgttgcagcagtaattgcatatttcatattcataattctccttaagctgtttttttattattaacagcttaatcataccacctgttattttaaagtcaacaggtttggacaaaaaaattcacttatcttgaagttaaaattcaaaataagtgagtttatttttattacaaatcatttttttcttagtgaaaaccaccaaattaaatggataatcaaaatcatgataaatataaaagccaaaagaccgattccttagctggcatgtcgggaatcggtccgtttatttatcttatgactgtaatatatttcaaattctttttaaacgtgaattggtagtcctgcagctaattctgctgcatccataatttcttcacccaatgttggatgtgggtgaatggttaattcaatatctttaattgttaatccattttcaatcgctaaagttagctcagaaatcaaattagaagcttccggacccacaatttgggctccaataataccgccagtaggattgtccgtaattagacggataaagccttctgtttggtccatagtcatggcacgtccactagcagcaaatgggaacttgcttgatttagcatccaacttcttttcagcaatagattgcggagtttcacctacagttgctaattcaatgtttgtgtaagcaacggctggcaaaacataatgtgtatcatgagcatctttgccacccatagcagcagctgccaccttagcctcaaaactagccttatgcgctaaagctggtccagcgaccacatcaccgatagcataaatatgtttaactgatgtttgcatggaatcattaacttcaattaaaccacgcttacttaacttgatattggtattattcaaaccaagttgatctgtgttaggacggcggcctactgaaactaaacagtagtctccggtaaccgtcttggttgttccatcagcttcataggttactgtaacatctttgtcagtttggtttgcctcaaccgctgtagcttcagtaacaatttcgactccatttttcttaaagttattcaaaactggctgaatcaattcaccatcaaatccatttaaaatgtgatccaaaccttcaatgatggtaatctttgaaccaaggttcatgtaagctccagccagttccgctccaatcaccccaccaccaataatgatgagatgttctggaacatcttttaagttcaaggctccagtggaatcaattactcgaccactaaacttaaagtgtgggatttcaactggacgagaaccagtggcaatcaaagctctcttaaagcgatatacatgggaatcatctccgttgattacgttaaccgtttcgttatcattgaagtaagcttctcctcgcacaatttcaactttgtgtttcttaagcaagagttccactccaccagttagtttgttaacaacctgattttgtttccattcttgagttttagtgaaatcaattttagattctgataccgaaactccaaatggattaccatgttgtaaagttgaatagagatgtccagcttgaatcaaagctttagatggaatacatccaacattcaaacaaactcctccgatataatcacgttcaacaatcacaactttttgtcctaattcagctgctcgaatagcagcaacgtatccaccaggaccagatccaataattaaagtgtcaacgttaattgcttgtgtaccaactaccatgactacacctccattagcatgtaggcagggttactcaaaagtgccttcagctcattcataattttttgtgctagagcaccgtcaattaaacgatgatcaaagctaagtgatagttttaatgtatttccaactgctaactcaccatcttcgttaaccactggagtcttacgaattcgtccaattccaagaattgcactttcacctggattaataattggtgtaaagaatccacttccactttctgaaccaatattggtgatagtaactgtgccacccttaagttcattaggcttcaaatcaccggcacgaccacggatggccatgtcatcaatttcttgcgcaacttccataattgattttgatttaacattcttaacgtttggtacgaaaagtccattatcagtatcaactgcgaaactgacatttgtatcttcgtaataaacgatttcttgtttttcaatatcaaccattgcactaagttcagggtacttatgggctgccccagcaagggctttcgcaataaatggcatatatgttagtttgtagcctttttgtttagcttgttccttaaattggttacgaagatccattaacttagaaacttctacttcatccatgattgttacatgtggaatcgtttgaacttggttagttaaagtcttagcaattactttacgaactggtgacaatggtacccgtccagctttaacttcagctggcgcagccggagtaactggggcgcttggcgccttttctgattctgtttctggaactgaagcagctggggctgggcttgctgtaggtgctgatgcaggacttgctttaaagttctccacatcagccatggtgatatgtccatgccgtccagttgctggcacctgagttaaatcaatatcattttttctagcatattctcgtacagatggcattgctaacaattgtccatttgaagtatattctgcacctaccttggttacttcaggtgcagtttggtcaactggtgcgcttgattctggttccggttctgtagatgctggtgtttctttaggtgcttcactttcagcaccagcgccacttccgtcaccgtcgaattcaatcaatggttcgccaaccttaactaccgttcccgcttctacgaaaagttttgtaatctttccaccataaggagaaaggatttcttgtaatagcttatcattttgaacttcagctactgcatcttcttctttaatcgtatcgccgacttttactaaccagtttgcaatttcgccttcagccattccttcgccaatatctggcatcttaaaaatttcagtcaaagttcacgacctccttaactttttcgatgatatcgtctgcttttggtaaccattcattttcagcaagggcaaatggatatactgaatctggagcagctacccgtccgatcggtgctttcaaactcataatgaagcgttcactaatttcactcattaccatcgcaccaataccagcttgccgttgtgcttcttgagctacaacaactcgaccagtcttttcaacgctttctccaattgtgtcgagatcgagtggactaaccgttctcaaatctacaacttcagcgtcaatgccgtctttagcaagttcttctgcggccgctaagcttgtatgtaccattccaccataggtgataattgatacgtccttaccttcacgaatcacattggccttatccaatggtgtggtatagtaaccttctggcacatcgccacgaattgaacgatataaacggagattttcaaggaagattaccggatcattactttcaacagctgatagtaacaatcctttagcatctgctggagtagctggcataactactcgtagaccaggtgtttgagctactaaaccttccaaggagtccgcatgcatttcaggagtcttagttccaccgccataaggagagcgaaccacaattggaaatgtacgtgttccatggaaacggaaacgtccacgtgccatctgtcctgcaagtgaatccataacttcatatacaaagccgaagaattggatttccataattggacggtagttttgggttgtcatcccaattgccattccaccaattccactttcagctagtggggtattgaaaacccgatcttcaccatatttcgcctgaagaccatccgtagctctaaatacaccaccatttttaccaacgtcttcaccaaagataactacattttcatcgttagcaagagctaaatcttgagcttcagtaatcgcttgaatatatgttttttgtgccatgattacttgccctcccctctaaatttgttaatttgttcttgtgcagcttgtcctgggacttctagagtttgttcaataaagtctgaaatcttttgtttatcgattccatctgcttgttttacgccgtcatcaatttgttcattaaccacttcggtccagtcattttcaatttcctcagaccagaggcccaatccttcaagatattttctgaaacgaataagtggttctttcttggtccattcgtcaatttcttcttgagtacggtaacgaagtgggtcatcaccagacatcgagtgtgcacccaaacgattggtaattgtttcaataaatacaggtccattaccatcaactgcccattgacgcgccttcttggatgctaggtacattgcaattggatccattccatccacaaccaaacttggaagaccagctgcccaacctttagctgctagatgaggagccttagtttgtaatttacgtggtgttgagatagcgtattcattattttgtgagaagaatacggcgggtgcgttatatgcgccagcaaagttcattccttcgtaaaaatcaccttgcgaagtaccaccatcaccagtgtaggcataagccacattaggttgtttacgcatcttcaaacctagggctgcaccagcagcttcaacatattgagcaccgataataatttgtggcatccagccattaacatcgtcaaattcatttccttcataatggccacgtgaccacaagaaagccttataaattggccaacctttcattactaattgcggaatatcacgataacctgggaaaagccaatctcctttttcaaacgcataatttgaagcaatttgagaggcttcttccccaattgttggagcatagaaacctaagcgtccttgttttgctagtttagtggaacgttcatgtagtacacggctaaataccatctgtttcataagttcaacgagctgatcttcgttcaaaccagcctctttaagggcatcctcgtctacaatctcaccatcattgtttagaacttgtagcattggaaaactgtctgtttgtttttccatttgaagattgaaatctaacacttgtttattgtcatcttttacagccataactaaacctcctaagcttcaaataatttaattaattcatcatccgtaatgtttccgaagtaccggccttcatggttacgttcaaagacggtcttaatctctgcagtttcaaatggtaacccaataaattggtctttgatttcgcgccaatcgcgtaaaccaaggaaatcgcccgtgaaattgatatcacgtatggttccaccctcagcttggacttgaacatcgataattccaccgtcatatttagcatggttcttaaagttaaattctggtgaacgaccataattccagtcccaagttgaaaacttatcagccgttagttggataatctcctgtttttgttgcggagttaacacaatctcttggtctttcccgtgatcggttaattcgtactgaaccgcatcccagaaatcttgaagggttaacccttttggagctgcatctttgatcattcccactcgacttcggaccgatttagcagcttttgaaatgaacttttcatccgctacatttaaggaacgaaccatggtatccacattactatcaaacagcaatgttccatgatgcattaagtatcctttggcatagcgctgggctacaccagagatttttttaccattgactaacagatcatttcgaccggaagcctcggcatcaatccctaaagtatgtaaagctcttaatacgggctcagaaaactttttaaaatcaacatttgctgctgattcaattggtacaaataaggtgaagttcagattacctaaatcatggtaaactgcgccaccgcccgtcactcgtcggacaacctcaatttggtgttcatcaacaaaatcttggttaacttccccaaaagtattctgattctgaccaacaataatagcattattattctgccaaagtgcaaaaactggttccttggcatttaaattatttagtagccatgtgtccgttgcaatattagtgtacgcatctgttcccatgtatgtgacgtatcgcacaatctaaacccccttatcacgctaatggaagcgctttctaagtacatctttatgatagcacatttgaaccgttttagggctattttttgggtttaaaatgttttaaattgaattttggttttgtgcaattttgttcaaacctcaacattaaatttacatatttgggcaaagttgttaatttttataagataaaaagactagcttcgaaagactaaaaaacctcaaactaattctgataattagtttgaggttttgatttttttgttgattttttgaccaattatagattttcttcagcttgaatttcagaaacacgttcactaatcttcaagaatggtaagtataagaatactccgaccacaataattaagatttgtaaaataactgcgcgccagtctccggctgttgaaagatatggtccgattaaaggaggagttgtccatggtactaatactactgttcgactgacccagccccaaagtgtagcaaagtaacccatcaaactcccaacaaccgggaataaaacaaatggaataatcaaaggtaaattaaagacaattggaaaaccaaaaatcatcggttcattaatattaaagattcctggtgccaacgataaaccagcaatttgacgagaagatttagctttactaaaaattaaaatagcaataatcaacgcaatcgtactacctgaaccaccgattaaggtgtaattacttacaaatgaagttgtaataatatttggaatggcttggtgatgtgcataagcagtcatgttttcgttcatattaactaatacaaggggatcaagcaatgcacctgataatacggtttgatgaatacctaaaccaaaaaggaaattagctaaagtataaattacacagtaacccacaatacttgtgttaaaacctcgtaaaggctcttgaatccaagttttaattaagttgattaaatcggtgttgaaaaatcctgcgagcaacgctgcaataatagcaaaaaacgacattaataaaatggctggaattaaaacactaaatgaagcagaaactgctggtggtacattttcccctaagtgaatttgtaattttttaatcgaggcaagtttgataaagaggccggttgcaattagcccaacaaaaatcccaccaaacattccttgcgttcccgtattcaaataactaagtccacctgtgaccgtcgccatttttgcccctgctgaagcaaccgttcctaactgaatgcttcctggcattaggatgaaaatacttgctaaagacatcgcagcagccgcaattggattattaaagcctttattacgagcaagactataaccgatcattggcgcaactaaaattccggctacatttaacgtcccattaacaatggcgtttccaatcacttggaattttgtcagcatatccccactcaaaaaccaggtaaagacaacgttatttaacagtaccccaatcccggctacaataaacattggtaaaatgacagcgaaagcgtcacggagtgaacggagatacacccagtttccgactttaactgagatttcagtgaacttagcaatgaatttagaattttgcatcttatcattgactgattctttgttcgaactacccattttaaatcctcccattaaagatcattttctaaatcgttcccattagtttcaataacttttttaaaccatttataactcttcttagggacccgtttcatatcacgtaactcgtggtttccacgatttacgtacaccatcccatagcgtttttccatatttccagaagaactaggaatgtcgattaatccccaaccaagataacctaagactgggacaccatcttccacaaccgcatcaatcatcgcttggatatgatcacgatgatattcaattcggtaatcatcttgaatctctgtcccatcgaatatttcacgataaccgataccattttcaattggaaacatgggaataccgcattcgttgtaagtcttagtgataacatcacggaatcctaatggatcaatgttccatccccaatctgtagcctttaaatatggattttcgacccctccataatctagataacgattaggcatcgttccctgtggaattttggttgaatcaacaacgttacttgcataataactaaacgaaataaaatcactcttcaatttttcaaatgctatttgatcttgttctgtaaaatcgatatcaaaatgatgattcttgatatattgggtaacttcagtcgagtagtggccatgtacccaaacctccaataaattacgattcaaaaattcatcaatttggcgggccacataaacatcacgcggacgacaatttttaggataagattccacatatgctaacatccctccaatttgagcgtcactagtttcgtgcacataattagcgacttgggcatgggcggtcattacgtggtgggcaattaactggagttcttcgtcagtttggtcacctttcaaatagcctgcaatgtggaaagcttctgtctgtgaatataagttttgttcattaaaggttacccatagtttcacacgatcactaaagcagtccaccattttcttaccaaaacgcacaaatgcgtcaaccacgtggcgactcatgaagccgttgtatttttccgctaaatgtaatggcatatcgaaatgatacaggcaaatcatcggcttgattccacgtttcagtaaatcattaattaatctgtcataatattggataccttcttcattaaaatccccatctccggtagggtttacacgactccatgatatttggaaacgataacaattcattccttgattagccatcaaatctaggtcttcctcataatgatggtaattatcaatagcaacatcccagtttgaggtagtttcggttgcttcatatgtatcataaactgatggtcccttaccgccttcatgaacacctccttctgtctgcatgcttgatgttgagtttccccataaaaaattatctggtagttttcctttcaaaataacgctcctctctaattgaattcgctttcattatagctttattttttatttaagtaaatacttttattttaaaagactatacttttataaaaattgtgattgtatttaagatacgctaaaatgagggtaacgtcttagaacggagttttaaacaatatgtataaatacgaaaaaatctcgcaagcgattcgcaaacaaattattgaacaaaaaattaaacctggagctttactgccggatcaaaatcaattagctaaagaatttaatactactcgtataacgattggcaaagcactccaatccctaattattgaagggcttatctatagcaaacgtggtgccgggacgtttgttagaaaagatgctcatttgaatgacgaatttactaacgatgttgataaacctttggggactacctcgactcatccgcatagtaaagtcaccagtaaatatattcatttgactgctcggattgctaacgaagtcgaaaagaaaaatcttctactagaagatggtgagacggtctacgtcatcaaacggacgcgttttatcgagggaaaagcttatagttatgaacaaacaattatgccaactaaaattgcaacaataaccgaagaagttttaaaaaaatctatttaccaatacctagaacatgagtaccatttagaattagctggttcccatcgacaaatcactgcccgtaaagtttctgaagaggatgctaaatttctgggtgaaaagttgggcgatccaatcctagtgattagccaaactagttacttagtagatggaaccccttttgaattttctgaatctcgttttccataccaatctagcgcagtatctgcggatgtcaatttacttgaataaaaaagcgttcagaaaaaattttctgaacgctttttttattttttaatttttaaaatagattctgtatccattcgtttagaagttatgcggtttacttgtgcctgttcctcttcaaatcccaatccaatcccaacgataatttcctcatcatctggaatctttaactcttctcttaaaatctgcggatacttcacaaaattatatgcgacaatcgagtcaataccttgttcagttgtggccaacaaaatattttgactaaacgcacctaaatcaaacaaaaaccatggtgtatatccttttggtaaggtcaaataaactacagcttgagcattataaagctgactggcttctttacccaaagtttcttgccaattatctcccaaaactgctggtatgccatggctccattcagccatgttcttttgagcttgttcagaccagagcttccgcgacattggaggaatatccgaattagtttttgctcctgtaattgtcaattcctgttgttgctttctaatagccttcaaagtctcaccttgagctacataaactttttgcggttgtgaattgacccatgaaggtgctttttgagcaattccaattatttctttcaattgctttgaatctattttttgatccgtaaaatgacgtacggaatgacgcttttgaattgcttgtttgacttccatcctgtctaaacctccgaatcgtttattgcaaatttggaaccatactgcaggttttagtatacgacttaaagtttactttaagtcaagagttgaaaaagtttattgctcaataatctgccaaattaactttatcagaaattgacatgactttattttcacctttaaattccattttagctcataaaccataacgacccccaaaagctagagtcttagtctaacttttgagggccactataaaattatgttgtagttctttttatttatcagtattttctgcagcaaccttttggaattcggctactaaatcggcattttccgtaaccttgaagttcattccatcgctagccgattgagaagttactaatacttctggttggccattatggaacgtaaataagtacatgtattggtcaccagtatatacagctactaccttgtattcactgtctgccttttcacttcttgtccattgcatggaaacctcttgctggttgacatatatttgtcccttagagagatagtcagggaaacttactccatcgaaactaacggatgcgttagcattcgtacctgtgtaagtttggcccatggtttgttgccaacttgaaatgaaagctgccaattctgaatcttgtttgtcagtccaaattttcttttcagtctttttagtcttctttgaagaagattgtgctttagatgaacttgatttaccttcttcaactttgatcacttttgtactacttgatctatcagaagatgaagttgtgttcgtgacgtgattaggataaaagaacttataccttgcaatcacgacgattaacgcgagaataacccaaaccaccgaattgattgagccaaacgagcgcttttctggttttttcatatgtcgcataataatcacctcgtttagtctattatacagtaatttgataaattggaaattaactgtaattactcttttatagaggactacttaatttataaaaaatcacattacatcaaacctgacgtaatgtgatttttaattaccttctatctttcaacttcttgtaacttttgattgtcatctagttgagatttaccttctaaatgtttcttttgaagttgaaccatgctgaaccatagcaatgcaagagctataattgcgaacaataatagagctcccatcgattgaacaaccgtgatattccctaaaccagacgtaattgattgacggaatgacaagattgagtacgtcaatggcaagaatggatgaattgcattatagaaactgtttgtaacttccattgggaaggtaccacccgaaccaccaagttgaagcatcaatagaatcattgcaacgaatcgaccaggattatcgaaggccatcgataagaacataacgatgtacatcgacgtcaaagcaatcataattgcggttaagtagtattgacctacatgatcaacatggataccagcaaccatcataatcgttgcttcaatcaaggccattccaagagcaaccgctgtaccaactgatactttactcaagaaccagtctgtagctgtaccaccacgcttagaaatcttacggattgggtaagcgaagttaaagacgatagcaccaacataaagggctaatgaaagcacatatggtgccaaagcatgcccataatttggcacataactgtaatcagtttgtttcaaatgggttggagcagcgaacatttgagcagttttgcttgtaagaggaacactgttaacttgttttgaacccttttctaaactatctgctagcgtaccattaccatcactaatttgtttgctaccgtcaagcagctgatcagagttagcatctaattcacttgcaccggcatttagcttattaacaccgtcaattagttcacctgtacttccatttaaggtttgaagtccatcatttaaggtatgacttcctgaatctaactgttgaacgccgctaatcaaggttcctgtgcttccatttagagtttgaagtccgctattcaatgtgtgacttcctgaatctaattgttgaacgccacctacaagagctggaatttgaccatttaattgcttaagtccaccagtaacttgtgatgatccaccaactaattggttgctaccagcagctaacatccctacaccactaaccaaggttggcatttgtgaactagcagtactgataccaccattaagttgacttacaccatttactaaagcagctccgtttccactaagttgagaactaccttgagttaattggctaattccagattgtaatgccggcatttggccattgatagtagtcaaggctgtatcaagtgtttgagcaccactagttaatttcttaacattatctgaactcttattagtttggctagctaaatcacttgcaccgttgttcaattgcgacacaccatcagataacttagatgctgagcctgagaatttatccacggcacctgaaagcttgcttgagctatctgagaggaccttcaagttatcagtaacactttgtgatccttgagccagggctttaatcttagcagctaatgtggccatttcgtcaccgtttgcagaaagtgaattgattcctgaagcaaccttttggaatgaagcacttaaagctgcaatcttagcatctaaatcagcttgttttgaagataatgaattcaattttgaaacttgtccttcaacactactaatttcaccttgaattgctgaaattttacttgtatcaatagtttgtgaagttgtagttgattgggctgtacttgcgccagaaccagcaacacctgctaaagcggccttggctttagctgcatcttctgcggataaaccagctccatcaattttagcgttgattgtagcttgtgatactcctgaggatgctggtgctgctttagtagtagtcgttgttttagctgaactagctaaagcaccgacatcactcttaattttatttagttggctactaattgaactagctgcactagaattgtttccgccagaaacatctgttttagatagcgctgctagttgtgaattgattgaatttaattcactcttcaaagcactagcttgcttactcatatcagatggagtaatttggcttgaaagttggttcaatccgttagaaacttggctattagcaccatagagttgttttgaaccacccgcaatactatcaacagctgacttcatttggccaacgcttgatggtaagtccttagtattattagctaagctagcaataccactttgtaaagtggaagtaccatcagaaactttagtagtgtattcgttgattccgctatttaaatcacttgctccagatgaaatttgtttgatgccacctactaattcaccagtattagcatctaatttttggataccactattaagttgataaacaccaccaacatattgaggaactgcaacatttagttgagcagaaccatcttttagttgtgatacgccagtaactaaagcaccactcttagattgtaattcagaaatacctttatttagagcaactgctccgttagtaacttgtcctgaaccattagccaactgtgatacaccagaagaaagggcaccagttttgctgttcaactgatctaagccagctgataattgacttgaaccaccagctaattgagctacaccggatgccaaagttccagtcttactgtttaattcatccaagccaccagttaattggcttgaaccatctgctaactgttttacaccagattgcataggagccacagaaaccgccattgtagcaattccatcgtgtaattgtgatacaccggccgtataagtcttagtaccatcgtttaattgaaccgcgccgtctttaagtttattagcaccatcggccgcgtctttgaaacctttaccagcttttttaacttgatcaaacatagctgtagcataagatttagtaacttgctcccgtacttgagagtttaacttttctgtacctacgtcactaattactttaccaatgtagtttagcgaagcattagtagcatacttcaactgcatctttttaggatttttatctgttacagttgcagcatttgctgagaagttcttagggattgtgactactgtatagtactttttatccttcattccttctttagctttattagctgaaacgaatttccagcctaactggtcatttttcttcagattggaaaccatctcgtccccaaccgcgagttttttaccttgatactcaacgggtttatctaagttaaccactgcaactggtaaattttttgtatctccatacggatcccatactgatttcaagaagaaaacactatataggaaaggaatgaaaataattgccagaactgaaattaagattaacttatttttccctataaacttccattctttgcgaatcatccaactagtcccctttaacctttaatttatatatccggatatatgaatcatgatgtacttctaaaagatctatcgcaataacttcttatcttttctcaagatgtcaatcagttcttggacctgagccaatgcgtctttgatcgtcaattggtaaatattacttgtcccaaccttgcggacggaaaccaaactgaggtcttttaactgcttgatatggtgtgatacggctggttgtgaaagaccaattagcttagttagttcactcaccgtcaaccccgcatcactttcgccaagtgtaatcataatttgttgacggcgttcgtcagaaagggcatccaacagtgggatgttcttcttgaacgcagcaagagcagcattgtttttgaccatctttctcctccattcgaatattcgaatatttaaatacaaattaaatcttaacgctaaatttaattcaattcaaccttaagattaactttaattatttttcttctagatcagacaataagtccttagccatcttcttggtaagcatagaaataatggcactatgctggagggaaaccaccgccgtttcggctaatagttcgttccacaaattacgcggtccatgttgagaaattcgttggacttcttcgttaaaagcattcacaaaattattgtaggccctccttgaactggtcaacttaagttcagcttcgaaccctcgtttaatttcatctaaactcaaaatgctttttaaacatccaatgatgatgacagcagccaattgcatccgtccgtacagtttaccttgtgggcgaataatgactgcttgcttcagataattatgcatcatcgttggtgttaacaaatcgacttctaatggacgcaaataattattagccaaatcaattacttggtccaagtgaagttcaatatttggtaattcatcccatttgggcaagctcattttggcaaaattttctaattgttttgaatccatttgatctccttcaatcaccttatttaataatttgtacaccaatgccaattaatcctggaccggtatgtactcccaatgcaggtgaaatatctccattataaaattttcccatattagggtatttatttttaaactcagtactaatttgattcattaacccctcattgagaccgtgtaccacagctaaattaaacttttgagcattcttaagggtatcttcaactaattgtagcatttttttaagggcttttttctccccatgtgccttcgccactggataataaattccctcatcatcacatgaaataatcggcttcaaattaataatggaacccaccaagccggcgacacgtccaatacgcccacccgcaattaagtattttaaagttggaacatagaaaaataccttcgtttgattagccacacgctgaacttcttcaacgatctgattgaactcccagccttcttcaatcacttcacttgctcttactgcagcaaacccactagcaattccaatatttttagtatcaattacctcaatttgaagttgagggtaatttttagcatatattttaacttgctgtgctgttccagataatcccgaggaaatacagacagcaataatttgcgtaaagcctcgttttgataaattatctagtgcttttgtgattaattcacccttagggctggccgtagttggcaaaggattggccttagccaacttttgataaaattcatctggctcaatatttacacgatcttggtactcttcttccccaaagaagactcccatcggaatcatttcaaaatattcccgattggcaatttcagctggtacatcggaacacgaatcgaccagcaccgctattttttgtttaagcatgctaacttcccctttgttttaaaaactatctatctagttcataaaactagtataacaatttcgatgactaacttagctatttaataaatttttcctagtactactagcttcttttcgttacattaaactaacgattgaaacaatccggtggtattaaatggtagaatagttttaatatctttcagaatatcgaggtttcatcttgaataaaatcgaattagcaacccaatttatccaacgacacttacaccaatttcagtgtcccatctgtaaatcgaatttcaatgaagttcaatccgggactttaatttgtaataatcagcattcatttaatattgccaaaaaaggaagtctcttctttttaaataatcctgttaacactgaatatactaatgagatgttaacttatcgaaatcagtttttgacggctgggtttttcaacccgatgttagaagaagttatcaacaatatttcgggagatttaattttagatgcaggttgtggagaaggaactactactaaatggatggcatctcatttcgacggagacttcgtgggtttggatatctctaaaccagcgattaatattgccggctctggaattgctcctcaaccctatcctttatttatggtgggcgatttagctcaattacctttcgcagatcaaggtttaacttcaatcgtcaacattttatctccagccaattatcaagaatttgatcgaacgctggcaacccatggtgaattaattaaagtgattcctggaaatcattatctaagtgaacttcgacaactcgtctaccctgatggtgaacatgcgacctatgataatgctccggttaaaaaccattttatcgaacactatgaacacgtcgaattttctaaaatcagctataaatttccgcttgacgacaaattattcacggcccttttcaatatgacacctttaacttggcaagctcaggatcgtaaagaggctattttacaagatggattaaaagaaatcacggcggaatttgaaattggtgtagttcgtaaataataaaaaggcttcaatcaatgttaacgaattgattgaagccttttttctatattattaatattttaaatttattgtagtttttgaatgtacttggattaagtacttacttattcttgtctatttattttcaaataacatggtcaaacgtacctaaaaaatgtcctaatatcatgaacaatgtctcgcaaagcctgaaaaacaagttttagaatccatcaaacagcactgttatcctgaagtttgcatataacttaagttttaattgaaaaataattgggttaaaacaaaatgaatatcttagctggaatgcagatattcacaaaaacataattaataataccctttgctcctgtacccgaagcaacatcttcaaccttacgctattacttcagcagtgtcaaatttaacgaattaaagtttaaaaggctccaccaccggaaccacctccaaaaccaccagaactacctccactaaatccgccggacgaaccactggaactagctgatactgagtgtgaaatagaagtactaatactgttagcaatgcctacatgcattccgttgattccataatagtaggcataaaatggaacattttcatttaattgggttccaaaatccgtctttagttttttagcaaccttttctgccaacccaaaagcggtggcatatggcaaaatttgttcccaaagaattaagtcaccaatctccgccgtattaaaatgagcaatatctttcatcatctgtttaaatcctcggatttgattatattgctgcaatccagcctcgttatacattgaaaccttatcccaagtagctaaaacccaagcttcaattatcaacgttaagactattccgcctatccagtacgagttagttgcttccccaaatcttccgataattcctactatgaaagcaaggattggagtagcaattgctagcccaagcagtccataacgataactaatattatacgtatctttaaagcgggctaaattggtatcaacctcagactgccactccttgtaccatgtagctacattattcttcttgtcttttttagcataatcattaatttgcttgatagtaacttgttgaccatcaccaatgcggtccaagcagtgatcgacaaaggacatgttgaatttaccttgacgctcaatttcagtggtttccttacctcgcttgccatagggaatctgtttgaacttcaatttaccttcagccgccaaaactaacatttcagcagaaacacccttagtatcagctttactcttgttaaatagcgcttctgcctctgctggtgagatgctcgggacgtcaaaactatgttccatgggcgtcgggatatcatattgatgatatccatgtttttttaaccaacccatcataccgattaaaatcagtacacttatgatggcactggtaattttagcataagtcgcaatgcgtcgagctcttgcttgggcttcattttcacgctttaccagttgatattcctgtttttttactgctgctagatgattttgattaacaatttttttattatcgggagttaaagccgtgggaaataccatatgtgcttccacaaaagtattctctggattgtctcctatatctaaagttactttacctttagctttatccaccgtagtgtagcctgcagcctccccatgagaccaagcatgaagtcctttaacattctttccaggtaatttaatggtaacttgcgcatcctctaagggtacatcccaacccgatccaattactttccaattaatttcagctgtatctttgtagttggtcaccaccccgttaatccgataatggtacgtaattttggtttggtcatcacttgatacagcattataaaccttaattttcatttgctttttacttgattcaactttagcagttaaattttcaccgctgttattaataggaacttggttttgggttcccttgttattagaaacggtaatcccctctaattctgctcccgcggttcctcttaaatcttgagtcaaataaactccatgataatcatcatcaaagtcgtacaaaacactttgattgatgttggcgctcccatccttatttacattaatctgcattctaaattgtgaaatttcgtaatccgccttaactgtcttaacattccaaaaaataccgaaggttagcatcgtgactaacaataggaacgttcttttcgtaaaaaatttcatattactcccccaaaaattgttcaataatccccgttaaatgttagtcaaagtatagcatacgtgagcaggtgcggacgatggtagaatctgtttcagagttgataaaaatgcttttctaagtccttcgatatttatatctcggctacctttcataccgacgtaccaacgataacgttatgactaccgcattaattaacgttgttaaagctgtcacaccagcgattatcgaaaacgttgcaaagcacattgatgtaaaataccccatcaatgtaacgacgatgaaagcaacgactacataattttctaactttagcgtagttttgttgtaataacttgcaataacaattccgatataaaatagcgctatccccacatacagacacgtaatcgaaaatatagcattagcttcagattcatggataaaatccaaggccaccgtgactaaactcaagccaaacaaaataaagtaatgtaaatatattagtaaatttccagtttcatgggtacgctgttcttcaattaaatgatcaaactccacaatatacgtaaaaaatagactaactacaattataaaaatcattatggattgaattgaaaatgtattttgcgtgaaatattttgaaatacctacgatggtttcaccgaacataataataatcaaggccgttagtcgttctaataaatgagagaaaataatggggtgcttttgagtatgtttcccggtaaaagcgggtataatccaactagtgataattccaaacaaggcaattgtcgtcccccatctgccagccaacactccccccgctaacaaacaagccgttctaaaaaacaaaattctcataaaagccatcgcaatgtttcggtcatactcatttttagtttgtacaaaaactagtaagtattgaattgccaaagttagtgataaaagccctgctgctataaagaagccaattaagtgtcggtcaaacgtgtcggaaaaagcattcgacatataaagtacaatcgccatatcgacaaaagataaaattacattagaccattgggacttcccatagcgattattaaaaaccgtctggaccatccacgaattgatcgaaacgattacaactaaagtaaagatacttagtgcacttgggctaattacaccattttgtagatgatggattaaccctgttacttgtgaaatcatatatacaaaaactaaatcatagaaaagttcgatcatcgaaactttttttaacagctcatttttcacaaaaatcaccttcattatctagagtctttatggatatcatagcaaatttacccccgtaaatttagttaatttatttttttaaatgtaagcattttatttgagctatatcaataaaacctttaatatctgaaccacaaaaggagggattgtataatgtttaaacatcaaaaggaactacagtttgaagcaaaaccagatcgcccagatccaatcgttgctaagtaccttcaagaattaattgggggacaatatggtgaaatgagtgtggccatgcaatatcttttccaaggttggagttgccgaggagaagaaaagtataaagatatgataatggatatcgctactgaagaaattggccacgtcgaaatgttggctaccatggtggcacgacttttagaagatgctcccatcgctgaccaacaagctgctatgcaagcggatcccacagttggagccatcatctctggaatgaacccccaacatgctattgttgccggtttaggccctcgccctgctgacagcgttggtaacccttggagtggtgcctacattattgctagtggtaacctacttgccgattttcgtgctaacctcaatgctgaatcccaaggtcgactccaagttgctcgaatctatgagatgattgacgaccaaggtgttaaagacttactttctgtcctactagctcgtgacagttatcaccaaaatctctgggctagtgcggttaaagaactcgaagaaaaagaggattcaatgttagtaccgacgactttccctcgggataaagaacgtaaagacattgcttacgatttctacaacttctctcaaggagatgaaagtagtaccgggccatgggccagtggagaggctttggatggcgaaggtgaataccactggtatgacgaaccaaaagtagaaggttcggctcctaatctaaaacccgtttctcctaaaatgtatggaacccctgaaaataaatcagaaatttaaataagcgaaaagcgaaaaaatcataactgattttttcgctttttttaagcttttattttaattttcttggggttgcgaaatagtaaccttgctgtttttctaaaccattttctaagagccatttactaacttcaagactatcaatcccttcaattacaagatcaattccagtatttgcagctagtgctttccataaagaaattgtaactgtaatcatcccttcttctacatttcgtagttgaattagtgatagcttgagacgatcaatatcctgcgtatattcacgaacggcattaaaactattcattccactagaaacatcatcaactgcaacactgaagcccatttcatggattctcttaatttgatctcgtacagaataattgaaatattggtcaatatcacggttactagggatactttccgtaacttcaatcatcacccgatcacaataaggaattaaacctttcattgcttcaaacgtagaatcatataatagttgctgcgggtcgaggttaaagctatattggataccaggattatcgttaataatctcaatgatgtttttaactaaccatgtacaaaaaactaaatttgatgcatcatcacgcatgtattccttatatagcattgcggggaaacgattctctccaccagtttttctaagtagtaattcgctcccgatgacctttttttcttccttttcggccgcatctatcaaaaaaatcggttgttcatagaagcaaattccttctaatttttgttcaagttcgctcaatttagcgaggccacctttccctcaaccgtaatactattacgtttgtttctcttagattgatacaaataatcatccacacgtttgtagaatgtttggaaatcaaaatcatcatctcttaattgagaaataccgattgaaactttaattccaactcgatcatgattgttaaccctaattgtttcttttaccaaatcatcgcggatggctcttacaattttttcacaatcatccgcagtacggcctcgaaaaataatggcgaattcttccccgccaacccggaatagttgaccatgagctttacgatctacaagttcatatgaaaaacgatccgcaaccaaccttaaaactttatctccaacttgatgaccgtattggtcattaaattgtttaaaatgatcaatgtcaaacattaccatggttaatggtgcatcattattagaataaaattcgaatacgcctttcacaaccttattaaagctattacggttataaactcctgttaacgcatcagtatctacttcctgcatcaagtttaaatactgcttcatgatcattctgacttttttgttaccaaaatggacgattgacattgcgattaaaaattccaaggtcaagcacataatatcgacgatagttagatgatgaatgtccttaagtacaaaccaccaagctaatccaaacataattaacgtactgtaatatttaacattctcatcaatcaaagtgtcattttgctggtagattgtgtatgaaattaagataattaccaagattgctaaaataggagcaatatcaaatcctatttgtccacgtactatccctaacccgtatacatacatgggtaaaataatattaaaccacagtacgacttttctatgaacgatatatagacagtagaatagcaccacaaattgagcagttgagtatttccaacctaactcactactagcaattgttgagtacaaatgagtaaacacgttttgtaagaaaaccatcgcgattgttagaccaacaccccatagtagttcttcaatgagtgttgaacttgtttttgttttatccatattcatctcaactacgtaggtacctgcagctaacatgaataatactccgaccgtaattgccgcaataactaccgtattaaaactaaaaaaaccttttgcccaatatatgattgtattcattacagtatttccataagtttttcctttactactccatatcccctattctctgaacaatttactattcctcaaaaataggtatacttttaacactgaagtccttttcttgttaagtaatgctcaaaattgcttaaatcaactttcaattttgtattttccaccccgttttttgtatggacttggatatttaaacgactgctatgcaatttcacccaagtatttcagatgaaagcaagaacgacataacaccatctagtgtattcgtccttgcttcattacatttcataaaatcattatcctttggactaaataatagacttgaatacgctatctatatctccaaagtaaacggaatttcatttttcgtagcttataaaagaatagcatatccatttttggaaaacaatccaacaagggtgtttaaaatttgtacatacatctttttatatagtatacaactttttaagtgtataaaaaatatctattatcattaataattaattttaaatattatgatttccaatcagaacgatgtttcttatatttatccccccaaaaatcctttcttcatctctgccctaagttgtaatctgactaggcgatatatatactaaaatattactagcgtttaattacttaaattaaacttttagcttaattttaagtgattacctcaaaggagaacaaattaattatggaatcaacatcttttgttaataatccagaaatccaaaaacatcggtggtggattttaattgccgtatgtagttttactttcatgtcgactttagatggtagcattgttaatattgcgttgccggtcatgagtagtactatgcatgttcctatgaataaggctgaatgggtcgtttccatttacctcattgttatctgtactctcttactcttatttggaaaattgggtgacgctcatggaaaaatacgggtctttaaaattggtaccatgttatttaccataggatcacttctatgcggatttaatactggtttaacattcctattgattgctcgcattattcaagctgtaggggcctctatgacaatgagcactaataatggcatcattactgaagttttccccgcccaagagcgtggccgggctttaggaatgattggttcatttgtcgcccttggtagtattgctgggcctggaattgggggtttaattctagcccattttaactggggatatattttctggatcaacgttcccattggattattagccattttagttggtcataaaattcttcccaaagatgtaattatgactcatcaaaaaatcgacaaacctggtacgatcttatttgccatcacgatgattaccctattcgttggtatttctatgggacaggaagtcggttttacccagccactgattctaacaatgttgttcgttgccttaatcgccttgggcacttttttatatgtggaatcacacgttgaaacacccattttagctttatatattttcaaaaatatgcgttttaccctcagtattatctgtgccttcttaattttcattactggatttttctttaacgttatttctccattttacttagagaatacacttggtttgcctgctaattatgctggatataccttgatgatttatccactgatcaatgttgtgacagcgccagtagccggtgctatttcagataaaatcggatctgaaaaattaacttttgttggattactcattattttagccgctcaattaggctacatcgtcactaatttggcaactcctttatggcttttcatgatttttatcggtttaaacgggttgggaaatggtattttccaagctcccaacaatgcacttgtaatgggctccgttgaacctaaagacttgggcattgctggtggaattaattcattagctcgaaatctcggaatggttgttggaatttcgtttgcaaccactgtattattttccgcaatgagccatatcgctggacatagtgtcacttcagttgtaccggggcatcctgaaatttttattgctggaatgcatgtagcttttaccgtttcctttggtgtttgtttaattgctaccctaatcaccggatatcgtttgttgcgccgtcaaaaataaaaagctggaagcattttaggttggttaatttcacctagatgctccagcttttttattttgtagtagtagatgatgttgttgtacttgtcttagtcaatgtcactactgttgttttatacttgccatcacgataatagcccaccgtgattttatcattaatcttgtgcttgtatagtgcctcacgaagtccggctgtatcagtaattgccttatcatcaatcttagtaataacatcgtatttcttcaaacctgctgttttggctggaccattattaacttgcatcaatacggttccgtccgttacgttagaaggtagtttaaggattgatttttgctgtgtagatgaaacttgggttaaatcgactaaagcgacacccagcgcaggacgtgtgattttaccattcttaaccagttgatcaataatggttactacttcatttgaaggaattgcaaatcccattccctctactgtagtagaatcactcccactagcagagagtttcatcgaattaattccgattacttggccagctaagttaattagtgggccgccagaatttccggcattgatggctgcatccgtctgaataacagttgcttctccattattctgtccattttcagtggtagtttccaccgttcgtttcttagccgaaataattccttgggttagtgaggtggcatattctgatcctaatggtgatccaattgccaaggctgtttcaccaactttaatgttatcggaattaccaaagctagcaacggtggtaactgctgatgaattaatcttcaacacggccaaatccgttacactatctgttcccacaatcttagcaggaagttttttaccattgctcataataatctcaagtgaacttgagccacttactacgtggttattcgttacaatataggctgtgtcaccactctttttatagataactccagatccttctgaggcggtctctaattctgaagagctacttgatgatttgctagaagaactcgattcgtttccaaaaattgagctaatgatactgtcagaatcattagtattagccttttgtaggttaatcactgaaaccactgaatccttaattgtagagaatgctttggatgattgactacttacgttaactttaacattactagtcttggttgttcctgtggtatttgagcccgttggtactgctgtattagatgattccatctggttatgaatgaagctcgccccaccataagcaacacccccacccagtaggcccgcaatggctgcaacaatgactaatttgtttgttttcataagaatgcgcggatttcccgctcccccctcatacaaaatttattttaaatttattgtacatggtaaatacgatggttatgtgaatttagtcctcaaaaatttgaaatttttattaaattaaagttaaaggatccgcaatttcgtggtcagtatctaaaatttcgaaatcgtgtccaaccgctaaatcgtgattttgcatcatggaagatactgttagatgcgctaattctttcatattattatggaggcttaaatgacctaagtagatttttttagttcgattaccaatcacgtccattagagcgttggcaccatcttcattagacaaatgcccgtggtcccccataattctttgtttcaaaggccatggataaccacccattcgtagcatctcagtatcatgattaacttcaaaaagataaccatctgcgttcctaatagttccagcaattcgatcagaaacataacccgtatctgttaaaattacaaatgatttacccgcatggtggaattcataaaactgaggttcagctgcatcatgtgaaactgaaaaactttcaatatcgaggtcatctagagacttagtagtattaggatcaaaaatgaatttttgctcagttggaactttgccaattttaccaccgatggcatcccaagttccttggttagcatagatatcaattccatattttcgagctaatactcccacactttggatatgatccgaatgttcatgggtaacaaaaagtgaatcaacttcgctaatatcgcgtccaacgctgtccattaaacctgcgatttttttaccacttagtccagcatccaccaagacttttcgttctggcgtttcaatatatgttacatttcccgtactgccacttgcgagtacgctaactttcaaaccatcttcgctcatttctagaccttcctacttaatttaacttaaattgatgcaaaaattgaacttcaaatgaagttcgtaaccaacttaatatgtggtgctcgtactagttgtagcttctgtcgttgctgaactggttgagctggttgtactagacacatcactactagcactcgttgcctccgactcagaagtttccgtgcttgaaacactactgctatcatcactcgctgcggtactaccacttgcttgcgtcgaggactctgtggttacttcatggtcctttttgatcaagacccctgaaaaagcattaattcttttcacttgaataccagtgctactcttactcttaattccgattacccatgtcggaacatatactactccgttatcggtggtaagtaaatttgtataacctaaatcggcccattccaccttggaatcattttgaatttcattatattgatatagccacgttactgctcgagtttgactaatcagttcgctcttttctcgcagttgtttctcatttaccaaatgtccttgcgtataaccagtaacttcattgctagcattaacataaaaagttagctttccagccttggaatagacggggtgtccatcaatcatctgcgtataaactacttggacatttgtacttaaattagggttgtactggtattcagagccataaacgatgttgtagcgattcttgacgaatgtattaagtactttttgcggttgtttaggatcgaccgtaagttcctcattcaaagtactttcaacgtaattatcaactactcgtgcgctttggtcagtgagacgtttgatattatcctttaaagatgtgtcgactgtcgcacttgcatagtaaccgttcatttttttatttgaaagaggcatataagtaatctggtcgtttctcatttccttcagtatcgtcgaattttcgcttgaattcgacgatgaagtcgtcccagcttctaattgatattgccagtaggaaccaaataaataggcattcaaaatagcgaatacaacaataaagatgacttcgattcttctgaaatccatttcgttcctccttagctaactaaatcgcgatatgacgtccagtcgccatggtacttgataaaccaggttggttcaagttcaaccgttgaattagctttagttgtacttggacgttcatatccaatatcaatgtcttcaattttatcagtattaattccgctatattttaattcatccaacatatcttgcgtacttggtagctccttgtcactctttgatgtgggaactggaacgtcaagattatagattgaaaatgaggtcgtggtttgttttgcttggtgagcgactttaatcgtatccagaccgtctgcattgaagatcgggaagccttctacaaaatctctaaattcgatttcatgattattttcatggaaattgaaatagcgcatgttgtccacttgtacccctagttgtttcatctgataaaagctcaactctagatttcgctttaagctttcttcagtatcattagctttgctggcattattaaacgccacaaaaccattgtttttaatcagcaaacgtttggttgtatcatttgagacatattctgtaccatctttagttttcttcgtatcaattgaatctgcatcagtatttgttaacaagttggcagtgaagacgctactgctctctttattaactgaaaaactataataaggtaccttaattgcagtttgataatcattaatcagattatgattcatgatggtttctttcactttatactgactatcactctgcttaatcaatttgcgtaactgctttaaatcttgtttagaagctttagcttggtaaacgtcataagtcgcatcatttaacaggaaaaactcgtttggcttattcacgttaactacaatttggctaatttcagcgtttgtatttaacttttgatcataaatactattgaaaattttcccagtgatgttacttggatatttcagcatcaaactgtgacttaacgtagcataatccaaaaaacgttctttattacctcttgaaacccgagttatgtttgataatttccaactcgaaatttctttaacagctgccttgggaaggctacttttagaattattaatcaattcttgttgttctcccttggtatagataacctgcgttggtaagataacatcgcctttatcccgattaacctggtttgattgtactttttcactggaaacctgcttagcgcgttcataccgagccgggttagtccaaattacccatgaaagcacgatgctagttaacgctaatattaatagaatgacatgtcggacaattttacgcgttttagtatctttcattattcccaagtatctccttcctcaaagggttcatatggaagtgaaatgtagaaggtagatccttcaccttcgcgactttcgacccaaattcgaccaccatgaagttggataacttcttttgaaatcgccaatcccaaaccagtaccaccttgagcccgtgaacgagccttatccacacggtaaaaacgatcgaaaatgtggctgattgaatcctttggaattcccaaaccttgatctgtaatactcataatcacgtgattgtgggtctctaatagccgacaggtaataatccccccatctggagaatatttaatcgcattattcatgatattatccaatacttgttgaattttatctgtatcaacttcaacccaaatatcacgacgcgtaaagtcgcgtttaatagagtaatttttatctggtttatcactatttttcagaatcatatcgaaacggtccaaaatatggttgaataattcatttaggttaacatattcacgttccaatctagccgttcctaaatccatacgtgataaatttagtaaatcattaatcatccgcatcattcgatccgtttcttcctgcgtaaccttcaagaaattaggggccacttctggatctttccatgctccttcaaccaatgcttcaatataactcttcatactagtcaaaggtgtccgcaattcatgcgaaacgttagaaacaaatcgttttcggtcttgatcaattttttgctgttcagtaacatcatgtaaaacacaaaccagaccactaataaagcctgattcacgctgaattaaggcaaatgaagcatgtaaaattaaatcttggtcatcatcggaaagatctaaaacaacctgctcttgattttcaagtaagtcccgtaaagtaaacgttcctcgtaaatcgagaatgtctaaaattgatttcccaacgatttggtcattttcaagattcaagaaatccgttgccatttcattaacgatggttattcgtccgcgtcgatctgtcgccagcaccccatcagtcatatagcccaagacggaatcaagacgccgccgttcagattcagtcgattcctgagattcttctacccgtacagaaagttcattaacagcttctgctagttggccaagttcatcatcaccataaatctgaacctgaccagaataatctccacgggcgatttgaatcgttcgttgccgcatttcttcgataggacgggtaatcgctcgggaaattaaaacggctaaaattagtccaattgtaatcgcaattaaagcagctactacgaaaattaacgtaatattattaacattttgatataccgattctagattagcgcgtatataaacaacacccgtcaagttgttggttgctcctgcagtgttaattaaaggaacaattgaaacaaaataacgcgtgttagtggttttattgtacgaaacttgttgataggttcgcgtattgtagattacatccttaacattgcgatccgttgtcttttgaccaacaatactctggttagtactattactcgttccccgaataacacccttggcatcaatcactcgaatttccgtgatattttgattattgatgtttccaatgatatcggatatttgtgagttagcgctcttcgtattagcacgttctaattgcgtactaatctcattttcaacataaggttgtagttgaacttgagttttaaattgattcaagttttgtgtttcaagttgtcgcacaaaaataactccaacgacttccaacgttacgactagcaacattgcaaacactagagctattttaaagttaattgatttgaaaaaattcgttcgtttattcatttagtctccaaaaatcctgaattaattaatcattttctggattacgtaaatagtatcccactccacgacgtgtaaccaaaatttgagggtttcctggggtttcttcaattttttcgcgcaaacgacgtacggtaacatccactgtacgaacgtccccaaaataatcatatccccaaaccgtttgaagaagatgttcacgagtcatcacttggcccgtgtgttgagccaaataatgtaaaagttcaaattcacgatgggtcaaatctaattgcatcccatcacgagtcactgagtatgaatctgaattaattactaaagatccaattttaatattatttttaacagtctcatcatcttgttgcaattgatcctgacgacgaaggttggcttttacccgcgccactagttcacggttagaaaatggcttagtaacgtaatcatccgcacccagctcaagtccaacaaccttgtctaattctgaatccttagctgttaccatgatgattggaatattatgttttgctcttacttggcgcgcaacctctaatccatcaatttttggtaacatcaaatcaagcagaatcaagtcgggcttttcttcttcgacttgggcaagagcttcctcaccatcatatgcagtaactacatcgtatccttctttatctaaattaaacttaactatgtcagaaatcggtttttcatcatctactactaaaatctttggcatgttagccctccttggaagatttatctgccatcaggtatgcattcctgataaaaatggtccaatccattaatcttggttaattataacatatacactaaaatcaatcggaaacgctatctgtagcacgatttaaatcgtttttgcatttttttaatttttttcgaaatttttttaaaaaaagtattgccagcccctatttttcatgatactatatttaagtcgagttgatacatattaattatatgggtggttagctcagctggcagagcaacggactcttaatccgtgggtccagggttcgatcccctgaccacccatcaaacacacgacacactaatcagtagtcacgcagcgtaaagccgtggttactgatttttttgtgcactaaaaacagtggataatcttttccactgttttttcatacctatttttccacttttaatacgtactagctacctgcttactaattacccatcgcccattgttcttctcaaaatacattttcatttgaagaggccaaacgttcttcgatccgccccagattttggcggttactaaattttggcccgttaattgtcccaaatttccttcaactcgaatatctttgatagcttcttctttggactccaagtactgcatttcttcattttgtatctgatcgatccattccagtttaggttgcacgtatcccgtcatatgcgttaaagtcattcgaccacctaaaatcatatctagtcgacttatatctttttttaccattgcttcattttcagctcggtatagttgaacaatttgttcttcatcttttgtcataaatttgctcctttgatatctttctatcctaaatgatatctataattaaggagccgagctattctaatcttaactctattaaataagtaaaacttatttaaaatgatgctcaaacatttcggcaaaagtttcaatataaaaccctgaattatcgactttccagtacatataatatttctgagtcaattcatgcccaccattgtgcaaaggtacagtttgaatgattccactatcgagtagggtttgggttcgctgattaacaattaaatatccttgattagctgcaatcagcatctgggcttcatcgtagttagcaactaatcgaaagccacctttaacacctaaaatttcttgataatatgtttcctctgccagttgttactttgaatcggtaattaaaatacatggaaagtcagctaaatcagccacatcaatttgctctgcgtggctaaattcccccgtttgacttactgcaaccatcaatccactttctgtcaaaaaatcatttacatattcattggaaggggctcgccgttgatcagaaaaagccagatcaattttttcttcacgcaaccaatcatacaattgttcatgcgttccattattgattttaatttttacttctgggtaagatttagaaaattcagcaacggtttgtaagaactccgttgttccaaaacttttcaaatatccaactcttaattcaggttcgttatcattggcaattctaacggtatctttaacaatttttttaacctgtcctaaaacatccctactatgctgataaaagtactgtccagctggggtaatttcgaagctccgaccctgacgcttcaacaataaaactcctagattattttcaagttctttaatttgttgggaaatagccgattgagaaatattatcgtcagcagctgcttgggtaaaactgtgtgcatcgaccacatcaataaaatactgcatttgttgaaacattagtttacctcacttcatggatttacctcattataaaacaaaaagagctgaaataaatttcaactcttctttaaatataatcattgaggggtgttaattccgacactatcccgtgaatacaaggtagcatcaaaagtgagtcgttttacaagatcagcaattgaactaaccgaaacatcatgtcctccgaacggttctccttttaatgtaacttcgtaatctactggaccactagtaaaccaacctggacgaattacggtgtaattcaaatctgaagcttcaacaacatcagctgcttgtcgatatgaacttaggaccgaattatattctaaattcccattacttccaattgttgctggaatttcattatagattcccatcgaggtaataaatagcaaacggtcaatttgattacgtttcattgctgatacaatattttcagcatatgttcctaaattaccactaagtgctacaaatacgacgtcttgctttttcatcgcctggtctaaatcatgggcttggtttacatcaccagccaccactttttcacgactaccgggttttaatcggttggcacttcgagcaaaaagggttaaatttgcatctgtttcacttaataaagtttgtctcactgcatttccaatcgttcctgttgcgccaataattaatacgttcatgataatccctctctttataaaatcacttattttttaagaccgatatttaaagtagctccgactgaaatcaacataaatacggccataatgatgatagcgtggtcatatgataatactgggctaatcaaattagctgtcagcgcggtgataattgaaagtcccactgaactaccaatttgatgaaccatgtttactacacctgaagctgatccggcaatttccctatccgtatttgctactccggctacggttagagggctcaaggtaaatccttgaccgataccaataatcaccattgtaatagctactgaccaccaatatcctgcttgtatgcctaccacagcggcgaaaaccaatccagctaaggtaattaccgttccagcaattaaaatctgagtattagtaaacttttcgtttaaccgtgataccaatgtagcaaaaacaaattgaggtagtgtttctggtaagaatcctaccgctgccattaatggcgtaaagtgataaacctgttgcatcgcttgtggcgttaagaagaagtatgaaatcattgcacctaagaaaaagaaccttgcaatataagcactacttctttctcgatctttaagtagttttaatggtgtaatcgggtgcttagaaactttttcttgccatacaaataaaaccaaaagtaaaatcccggtcataaccattggtaccggatgactagctccattaattccataaacaagcgcagtaattcctaagactgacaaaattgaacctaaccaatctaattttccttctacctttttacttgctggaatatatttaagtgttaacacaatcatcagtatccccacaggcacgttaagtaagaatccccagcgccaactagcgtaactagcaatcaatccaccaacaaccaatccaatgctggcacctaatccaccagtagcaccataatatacaatcgctctggttctcatctgatctcgataactatccattaacaaagctaaagtggttggagcaagaattgccgatccaattccttgtaaggctcgcatggcgataatcattaaaccattagttgataaaccaaccaataaggatcctatactaaagattaccaacccgattaaaaagacatttcttcgaccaaaaatatctcctgaccgtccaccaatcattaataatccaccgaaggttaatgcatatgcattagttacccacgataattccgaagccgacaaactcaagtctgctgcaatctttactgtacttgtaaaaacaattgaattatccaaaagaatcataaaataactaattaaaataattggtaaaaccataccaaatttctgcttgttcattcctatcacccgcatccaaatttttattatgtaattattctacaagctcccccattcctaaccaatttcgattcttgccgcttttcataagtttttcttatggataatcagggttatcccatgtaaacctgaaacccattaccatacaaaaaaccactactatatggaaaattgcattccatcctagtagcggtccataaaccaagaacaatctatcaattattcaatttcaccacggagtacccgatcaatcatgtccattactccactatcgttgttatccaacggtgtaaccaattcggttgcgtccagtgcttcttgttctgcatttttcatcgcatagcctagtcgcgcatgatgcaacatggcttcgtcattttgggtatcaccaaaagccatcgtttcatccatcgaaactttccaacgattttgtaattgctgaagtccatacgctttagtaacatggggcatcgtaatgtcgattccattgaaaccgctcatcacacttcccaagctatcccctaaggcagtttttaacagggcggcttgttcacgcacattatcaatatcaacccaatgggcatcaatcttataaatcggatctttaatgtctttaaagtgatccactggggttaattggctgtaaaaatacgagctaacgggccattccggattatccattttcatattagtaaatgcacgatgttggctcgatagaatcagctcaacgcctttaaacatcggagtcgtcaataagtactcaattgtgtcgtgtaataaagccggttttagcggattatcgtctaaaattttcccttgttcaatcgtaagggcaccatcttcggcaacaaaggttaaatcacccttaatgccagcaaatacttcctgacaatgagccatctgatttccactcgctactacaaatttaatttttcgttcattaagtttgtctaactgagcttgaaaacgttgatggtcaaaatcctgttgatcatttagaaaagttccgtcgatatcacttgcaattaattgaatacccatggtggcctcctacatattagctttttacaaattattttttactagggttaattggtttttcaacctttttaccaacttccattttgtcattgtagccccaaacgtatgctgcaataaaggcaataatggtagatacaactgaggaaatcaagaaaatccagaagctgcttaaatcagacggattgcttggattaaagaaggatgcaaaaccaatccatgaaccggcaaatccgtacatattaccatggaacaacccggttataaatccaccaaatgctgaaccaatcaatccagaaatgaagacccttctatagcggaggttaaccccgtaaatagcgggttcggtaattccacaaaaggctgaaatggcagccgcaaatgataaactctttaagttagttttcttagtcttaatcgccacggctaaaacagctgcaccttgtgaaatcatggtttggcaaatcaaagcatttaagtaactgtgtcccgtggtagctatgtcattaactaccaatggagtaattccccaatgcaaaccaaagattaccaatacttgatggaaaccacctactagaattcctgatgcccatccactatgaaccagtacccatgaaatcattaccgcaatccatttagaaatgccgacaatgactgggccagtaatataaatcgtaattccactaacaatcagaattgtaataaatggaacaaaaatcatggttagataacttggtaaatgtttcttcaaataattttcaattttaaatgccaaccaagcagctaaaatcatcgggaaaatcgagtatgaatattggaccattgggaagttaaatccacccaacatccctaacgattttccagccaacggagttagcgtaggatgtaccaataccccaccaattacggctgcgatgattggatctccaccaatgcgttttgccgcagaaaatcctactaaaattgggaggaagaagaaaactgaatcgccaatggcatttaatatgatgtataaattacttttaggacttagtagttccccaatctgtggcatcgttaagactgataataatcccttgagaataccagctgccgccaatgaccaaatcactgggctcatcgaaccagtaattacaccaataaaattattaaatccatcttttgttttttctaggaaattccggttatcagggccttgtggttgcgtagctttaacggcttgttcggttccttcttcatccccaaattctgtccctaattggtcaataactgcgtcataaacatcgactacatctggaccaatcactacttggtattgaccttgagcacgcataatatcaataacatggtcgtcatttcgaataatatcatcgtcgggtttattaatatccttcaaataaaagcgtaaacgagaaatacagtgaatcacactattgatattgtcgggtccgcccactgcatcaattactttttgagctgttttttcaaaacgattgccttcattacttttagaatgctccactttttctgaaaccgtttttaattttagatttgcaacattttttcctacttcaactgtatcagcttcaatttccaactgctctaacacttcactgctattagtgattgcaaagattatagtagtttgcttgccattattacgcactaaatctaagtcccaagttcctaggctacttcctgcttttacatgatcgccaacttgaactttaagatcatatggggtgccctttaattctacggtatcaattccgagatgtagcaatatttcgacaccactatcagttttaataccaattgcgtgcttactatcagctaccatcattactgtcccagccacaggagcaactagattaccgttagtaggttctaacccaaaaccttcccccatcatttttttggcaaaaacttggtcttctacttgttcaagtggaatcaccttaccacttgctggtgctacaactatgagattatcatttgtttttttcataagattattcctcacatgctctaatataatttcaatatatttgtaagcgcttgctatttaacatgcttttatcataaacttgtatatacaagatgtcaacaataaagatagcgcctttaattacaggttattgataaataataaattatattaccttgtatatactagttacatcatgttaaaatgtaagcgtttctaagaaaggggtagctcttgtatggaaagtaaatacgatttaataaaacaagatatcgccaataaaattattcatggtatctatcctgccagttcttatttacctagtgaaaacgaactttgcgacctatatggaacttcacgtgaaactgttcgaaaagctttggtgctcctgctagaactgggctacattcaaaaaattaaaggcaaaggatcaatcgtcctcgatgtttctagatttgttttcccagtttccggtatcaaatcgttcaaagagctcaatcaatcacaaaatatgcattcaactacaaaagtacttacattagagcctcgtttggtgcctaccaaggattttggtctcgatcaaaatagtgagttagaagctacttatattgaacgtttaagaaccattaatgatgaacccatcattattgatatagattacgtactctcaaaggtggttaatgatattccaaaaatggctgctgaaaattctctgtatgaatatttcgaagaccaacttggactggatattagctatgctactaaaaccatcacggttgaagagcctactgaacgccaacgtcaattattaaaaattccaccacacaaagacgtcgtagtaattcgaagtatgacttatctcaatgacaccacgttgttccaatttaccgaatctattcatcgagctgataaatttagttttgttgatttcgctagaagacaaaaattgaaaggacactaactatgaattttaaaaataaggttatttaccaaatttatcccaaatcattctatgattctaacaacgatggcattggagatttacaaggaattatcaaaaaaattccttatattgataagttgaatatcgatatgatttggttcaatccttttttcgtttctcctcaatacgataatggttatgacattgccaatttctatgaaattgaccctgtctttggtacgatgtcagattttgaagaattagtccgtaaattaaaggaaatccatgtcggagttatgctagatatggtgttaaatcatatttctactgagcatgaatggtttcaaaaagccttagctggcgacgaacactatcaaaaatacttctacattcgagatcctaaaccaaatggtgatttacccaacaattggacttctaaatttggtggaccagcttgggctaaatttggtgataccggtaaatatttcttacacttatacgacgagcatcaagccgatcttgactggcataaccctgaagttcgccaagaacttttcaaggtcattaatttttggcatgccaagggggttaagggattccgctttgatgtaattaatgtgactggaaaggacgtagagttaaccgacgctcctgaaggcgtagaatcaaaatttatgtataccgatacacctatcgttcaaagttatcttaaggaaatgcatcaagctgcacttcaagaccctgaagtaattaccgtaggagagttttcttcagcttcagttgaaaatggtgtgaaatatactcgtccggaagaacatgaattaaccatggctttcaccttccaccatttgaaggtagattacgaccacggacaaaaatggacgaaagttccttttgactttgctgcacttaaaaagacgataaatacttggcaagtgggcatggatgaaggtgatggatggaacgccctcttctggaataatcacgatcaaccttgggccttaaatcgctttggagattctggtaaataccgagctaagtctgccgaaatgctcgccaccacgatgcatttgcttcgtggaacgccctatatttatcagggagaagaaatcggcatggtcgatccagattaccaaaacattgacgaatatgttgatgtagaagccttaaacgcttatcaacgactcttgaaagaaaacaaatctcctcaagatgcacttgaaatcgtgaagtctaaagctcgcgataatagtcgagttcctatgcattgggatgattccaaatatgctggcttttctgaagttcaaccttggttaaaaccaactaagcaaactgaaatcaacgttgcaaatgaactagaacacggtgaaatttttgcttattaccaaaaattaattcgacttcgccgagaattctccattatttctgaaggagattatcaatcctttgaacttaatcacccttctgtattcgcttatattcgtacctatcaagaccaaagcttgttggttctcaataacttctatggaaatgatgctaccatctcaattcctagtaaatacaccactgaaactgctaaaatcttgattaacaactacgagactaatcctgaattaacaacaacgctgaaattgaaaccttatcaatccatagcaattctgatttagtgcaataaaataagtccttcaagttaactaagtagcttgaaggacttttattatctagcattaattttaatttcatgtttatacttgcaccaataaatatttaaagtagtttctcaaataatccgaagtggccagtccatcttcgtatagtgtgattcgataaccatcggcatttaacgtgaaagtgttacctccgataaattgcccctcagcaacgtatcctatatcgtctaaattgaacttcattcttgttattcctaaaccatttgaaaaagttaagatcattttttcatcgttaaacttaacttgagcatatccaatctctctggtaccttctgaagtcacttctacatacgtatacatatcaatcatcctcctttaaacagagcataatctatgaaacgcgtaccatagcaagccttaagattgctaagttaaaatattggttgtggaacgcgtttcatactttaaaatgagggtatggaccttaatcgaatttaaaataggacttgataataatgactaatattagaaccattgctaaaaaatctggatactcagcatctaccgtttcccgttttatcaatcagagtggttatgtctctgacaaagctagtaaggagatcaaacggattattgacgaaatggactacgtacccaatgccattgctcgtgacctgagtaagggccagacgtttacgattggtgtggtagtacctcacatgcgtcatccctttttttctgagttaacccatggaattatggacttagcttttgctgctgaatataatgtcctttttttggaatctcagtatgacgaaaagttagaacaaaaatatttagaaaaacttcaccgaaaagcctttgatgcgctaatttttatatctcgcaaattgccactaactgaattaatcaaatatcaaaaatatggccccgtcgtatgctgtgaaaatccacaggacaatcccattgcggctgcctatacgctccgtgaaagtacctatcaacaggcgttcgaatgggttaaacaaggtggctatagcaaaattgctattattttaagtcgtccgtacggaaacagtgccacgagtaaaattatttttcactcttacaaaaaagtttttggaactttcccagactccaatttagtctatacggattgctacaattacaatgatggctaccaatccgctcatttaattgcaagagatacgccagatttcatttttggtaatagcgacgatattattgctggcatttatcaatactacctagataataatttagagttgccggccttaatgggacaggaaaatcaaatatctggaagtctattaaaaatccccacgattgatcaccatctaaaaatgattggtcaagccgcttgcgaacttgctattacgggcgctatcaaatcggtttccatcgagtcagaatttatcatcagataacgtcatcctaatatcacatgctgtagtaaaatgagacgatgaagtcatcatctcattttttgttataatgacttctataaattttattcataggagattaggtagtaaccttgcaaacattttacacaattgcactacttttaacaggtgtaatcttatctaatattattaaacaacttgtgcctcgaattcccgaagcatttattttaattatcgttggagtaatcctatcatttaccccagcatttcataattttgaattaagaccagaattttttatgttagtggttattgcacctatcatgtttatagatggtcaaaaacaatccttcaatcgaattcgccaacgttttcgcgtggtattttttctgtcggtagttttagctggcgccagcgctttagttgttggaatcttaactaataattttgaaaccaaatggacgctaccagtggccattgccctagcagccatcgttactcccaccgatgcggttgctgttaaatcgatgaccagcggaactgccatgcccgaaaatgttaatgaagctttagaactagaatccttatttaacgatgccactggactggtaatccttgatttagctttatctgttttacaaaatggaactttttcagcaattaccggagtcgaacattttatttttgtcgcgcttggtggcgtaatcattggaattattgccggctttttaattgtttctcttcgcgttaatttaaacatgcgcgctaataatccggaaactatcatcattccgattagtctgttgaccccttttctcgtctatcttttagctgaacatttgggaacttctggcattctagccgtcgttgctactggaatggttcataattgggaatctgaacgcctccgtttaacttcaactcgagttcagcttacctcagcaaccgtctggaatactatctcaagtttcctaaatagcgtcgttttcttattccttggagtgactttaccgatggtttggaaagattttatccagatgggaacgatgacgattgctcaattaattggtattagtttactgatttatctatcaatgctagctatccgttactggtggtctgttcatgaaaatccagacaatcctgaccatttcttaggccctcatgacaaatccgtgcatcagctatggtcaaggatatttgcaattagtggtgtgcatgggaccgtgactttggcgatggccttttcacttcctactagaattggaggtcaccccttcccttatcgtgaagaattaattgtgattgccacgctagtaattttaattagtatgttagtcagtgctatcagtcttccgctgatgcttcctgtcaaaacgacggagtattcactcgctgatatcgatcatattcgtaacaagatggtggattatgctactttacaactacgtgataccatcgatgatcacgcggttcgcgaggccttaacggaacagttgcagtcccaaaagggggcattgaacggccaaattattgattttgatgaatatcaggagttaatgtttgaaaccaaagacttcattgtcacttacattcatggaccttcaatttcagctaaatatagtttagaagttgttaatatttatgaaaaaattctaaataattttgtggctcctaactttaatcctcgggaacactttgttaaccgagtacattatatatttaaaaagaactttaaaaaggtatcagggctttgcaaacacgccctctggcacgtcaaaaatgggcaaatcaccaaacatcaacgtaccgttgctcgtcaaaaatggttggctgctcaaccttcagatacgctccaacaacgtctggatgttcgggatgctcttttggaactcaacaatgaagtgatcgactctactgataaatacttagacgatgttttgcgtggtcgcttattacgtaaacaaagtaataaccaatatattaacctcgttcgtagatctatcaatcgatactgctcaatggttcgtcatgattataataaacaggcagtctttgtaagtagcaatttatacattcaagcctttcagcaagaatataactttattcaacgtggagtaagccgtggggttattaccctagaaatggcaactgtgctctatgatgagattaatcaagctcaatcactacaattacaacgtactcaacagcttcaaattattacatcctaagtttcttaaaacacctcctgcgcgttacttactgataagtagcgcctaggaggtgttttttagttccaattaaattaatttaaacaaattttgaacttcattttaagtttgaatgttagcaggtgctattcaaacccatgattaatacccgtatgtttcatatggctataaaatgtaactcagaaatgataatttatcataaaataatcccctattaacttttttctaggtacatttttataaaaatttgatttcaaattcaacgggataatcttatttttatctgcattcagatttaatttatttttaatgctaaccataagtaattaatatataattatggttgtacaaaatcgggtttagctacttttcagtgggaagttgatgttactaattaagttatcggatgttataaaagagaggtgtaagtaatgaataaattttgccaaagctgtggaagaccacttactactacaaatgctggcactaaagccaacggtgactcatcaaattactattgtatttcatgttatcaagatggagctttcactgaccctacccttacaattgatgacatcaaggcgaaagggattaaagaaattaaacaatcaaaaatgaatatattcaaaaaaatatttttgttaatttgttatccatctcgacttcaacgactagatcgttggcgggaatcctaaattaattcagtcattttaaaggttgaccaaaatttgtaagagcattttgcctactttaaatgtgaataaaaatgatatcataagtaaagttaaggtcttatttcaaattacagttccctcacttaggtaagttttgataacagttcgattctgttggagggattcagagaattaatctctaaaaaaaactaggagttggttgatttgcttaaagaatttaaagaatttgtttcacgtggaaacgtccttgatttagctgtcggtgttattattggtggagcttttacttccatcgttaaatcattagttaattatttaattaatcctttaattggtttatttatcggcggaattgatttttcagattgggtacttaaggtagccggagctactttcaagtttggtagttttatcaatgctgtcattaacttcttaatcattgcatttgttgtctttattttggttaaattagtcaacaagtttcttcctaagaaagaagaacaagaagacgatgaagctgaagcaatcgaaaatagtgaaatttaccttaaagaaattcgcgatgcattagtaaataatcctgaattactttccaacttaaaaaacaaagaagattcaactaaataacctaaaaaacgtttcttgagaaaactctcaagaaacgtttttttactaaagttattcagttcttaaagcaattgctgcatcttttttagcagccattctagctggaatatgcccacctaaaatagttaacacagcactaactatgactaagagaatggcatgaactggatttaattgagaaactccacttaaaccagtcatcttttccagtacgacattaattgggaaagtacataaccaagctaccacaattccgaaaagtcctgatccaatccctaagatggccgtctctgcatcaaagacacgggtaatatctttcttacgtgctcctagagctttcaatacaccgatttctttagttctttcaattacggatgtgtatgtgataattgcaatcataatcattgatgtaactaacgaaattcctgcaaaagccaccaagacgtacgtaatggcatccatcattccaccagtcagttttgaaatactaccggccatatccgtatatacaatttgatccgcttttttcttgccatcattatatttatcgaggtagtctaagacccggtccttcttcttaaagttacttggataaatttggatagtacttggtgtttcactaccacccaacatcgttagcatctggtttttggtagaagcatccattgtttcaccagtcatgatattctttttgctagctgcttgagcttttacaatattagaatctttattatcttcgtaaacggatttggttaattgatcactgtaggcgattccgttagataataagccatcgctattcttagatttcacccgtaagataccgacaacttttagcgttttagtatctttagcattcgccattgatgcatacttatcactaggaacatagttaccagttggcaattttttatagtaagtattattagttaccaatttggccgttttaccgatcaattgattgtaatcaaatttttggttagttttagctgtaattccaaagttctttaaagctgagatgttaatcttattatcgcgatccgcaattaaaacaacatcagtagccttctttggataacttccagataaaacgtggtaattcttctttaagaagctttgatttccatcacgatcaatgggataaactgagcctcccacacctgtaacagaagccatcattgaacttgtatctactgtcttagcatcgggatcagcattactaaacttaaccgtttgccatttaccatctttttggctaattaaattcattccggtactgtaagtaaccgcaatatttttagcgtattttttaggcattttcttgacgtaatctaggtacttcgaatctattttatttacgtgttgggctttatccgatttactcaaatcggcttccacatacttatgtttggagaaggtactgttttggctatccgtcattgctgcacttgaatctgaagcaacggccccaattgaaaccggcatagaagccatcgtatcactttgggtttggtcaatttgtttctggaaaccatttgataaggccaaaacaatcgcaatactgataattccaatcgaggaagcaaaaaccgtcaagaatgtccgaccttttttagtcataatattcttaaaagaaagtttcaaagctgtccaataactcatcttagtatgtttaagcttaaagttagtcacttcatcatgcccattataagggttggaatctgtttggattttaccatcagcaaattcaataattcggtcagcatattggcgagccaattctggattatgagtaaccattactaccagacgttctttagatagttctttaattaattgcatgatttcatctgaagtctctgaatcaagagctccagttggttcatcagcaagcagaatttctggatcattggcaatggctcgggcgatagctactcgttgcatctgaccacccgatagttgattaggtcgcttgttcatatgcttctctaaaccaactcgaattaaagcatctttagcacgacgcttcttttcttctccactcacgcctgataaagtcatccccatctcgacgttatcaataatcgaaagatgaccaataatattgtacgattggaaaataaatcctacagagttattgcggtaggcatcccaatctgaatctttaaagtcgtcggttgatttcccttcaataaccaaattaccagaatcatagcgatctaaaccacctatcatattcagcatagtggtcttaccagaaccagaaggtcctaagattgctacaaattcttgattacggaaagaaactgaaacgtcatcaagggctttggtggttgtttcaccgaccttatagtatttctttagatgttttaactctaacatatacgctacttcctttttcaattggttatgttaattatagacaatagttaacaattgtcaatcattaatcaaagttaaattaatatgctataataacgttatataaatatttataggaggtgaactacccaatggataataaaccttaccaatcagaatgggatcagttaccagaaaacgtcaaagtaacagcgcaattattcggcacacttgctcaaactatttttagctattttaacgatgaaactattaaaatatcgcctttgaattttatgattttaatggatattttaggtaatcctggtacctccatgtctgaattggctaaaagagtcggtatttctaaaccacaattaagtcggagcgttagcaaattagaagatctacacatgatcaaaagggtccacaacacggaaaatcggcgtaacgttaatgtttaccccgacaaagaaggtagtgatttaatggcgcagcaatttcttcgggttgccaatagattggataaaacccttagtgccctttcttcagaagaccgtgctcgcctagttcctttaatgacggaatcacttgagattctatccaaggctggtattgttcaacaataatttatttacgatttatgaaaaaagagccttacaagcaactacttgtaaggctctctttaacttcaatttaacttaattttttgctcaatttttgttacaaggtcgctaacctcaccattactataagtgactaagttcgtaattgtcgtttgatcaattttaggcgagctagtttgcaacacctgtttgttaattgcaattaatattttaggatctgacgcaaactttgaaagttcttcaacttcgccagtaacaacatccacgtctacaattcccacctttacgagcgccttttttagtttattcaccaacctcgaatcgagcatcgcttccactacgggtcctgccccatttgacgtctgtaaaataccaaccattcccgtattgataactacaactttttcaaccatgctatcctacctccaattttattagaaaacaaaatcccccaaatcaattgtagttgatttagaggattttgcttcacttattttacttagtagttgttttaagaactaaggattctggtgtaactaatgcattacctttgaacttcatcacccgaactgcatccatgttcgtaacgatgacgatcattggtgtctgcttacccgcatttttaattgcgtctaagtcaactttagctacaacgtcaccatgtttaaccgtttgtccatcttctaccttaacatcgaatggagcaccatttaattcaacagtgtcgattcccatatgaagaaggatttctaaaccagcatctgtcttgaaaccaattgcatgtttagtagggaatactgatgtaattgttccatcaactggagcagtaatcgttccatcagtaggattaatagcatatccgtcacccaacatcttttgagcaaacgtgtcatcaggaacttcctcaatatccatgtattgtccattagcaacactatagaactcttccgtaacatcccgtttaataccatcagcaaccgtttcttctgttggagctgtttcatccgcagtcttcactgaagaaattggggccttagcattctctaattttgcaagtgcatctgaaacaaattgaacttcagtaccaataataatttgtagattattcttatcaatcttgtttaatccagcagcaccactgcgtttaattgcattttcattaatattatctgtatcattcaatttaagacgaagacgtgtcgtacagttgtccacgacttgtaagttgtctgaaccgcctaaagcagcgtagatctttttagcttgaacagtatacttatcatctgaatcattagttgcaacttcttcaacatcatcgtcctcagctaattcttcgcgacctggagtcatcaaatggaatttcttaatcgcaaaatcgaaaccaaaatagtaaattacagccattacgaggccttgaacaattaaccataatggttggttagcgatcgggttcttcaaactaagcacataatcaactaaaccggcactgaatgcaaaaccagctgtccaatgcataaatgccgcaaatgcgagtgaaagaccagtaaagattgcgtgcaatacgtatagaggccatgcaacaaacataaatgagaattcaagtggttctgtaacaccggtgaagaatgaagcaaatgcagcagctaacatcaatgatgctgtagttgctttgttttcaggacgagcatttttgtaaatagcgtaagctccggctggaagtccaaacatcatgattgggaagaatccagcttggtacatacctgtaacaccctttgtaccttgagaagccaagaatttaccaatatcattaatcccagccacgtcaaaccagaatacggaattcaaagcttgatgtaaaccagttgggataaggagacggttgaagaaaccgtacaatccagcaccaacccagcctaagttcaagataaacttagcaaacgcaacgagagcgccgtaaactggtggccaaacaaatagtaacactacactgacaagtagcataacaagggcagccataattggtactaaacgcttaccactaaagaaggaaagagccatcggtaattttgtttcgtggaatcgattgtataatgctgcagcaatcaaaccagcgataataccgataaatacatttccaatttgagcaaacgaagcatcaacggctgtaggtttgatgttcattaatgtagcaaccgattcaggctttaatacattgaccggtagctcaaaggcaactaacccagcgagggcagcagccccagattgatcgacagacatcccgagggctaaaccaacggcaaataatagcggtagttgacctaaaacagcgttaccaccggcttgtaagaaatgagcaactacgtcattactgtaagaagcccaccagttaccaataccaaccagcaaagcggcggcaggcaaaacggctacgggaagttgtaaagaacgacccatgcgttgcaaatatgctttcatgaataatacctccaaatagaatattgaataaatgcgataatccaattctatgttagtggaaacgctatttcaagcgtaaattattggtataatccgctttatagggcttattttataaaaattaaaattggtatatacctattatcggtttttgaaagcgctattttaagaaaaaactacatatttaaatttaccgtggtctaaaggactaaagtttttcaaaaaaatattggtttcaacctccgtagaccgcttttttgaacaaccattaaatccttgtatcactattccctatctattgtttgctcaatatcaatcatttccagtagccccgttgcacattcactacccttatttccggctttaccacccgctcgattaagagcctgttccatattttctgtcatgagcaccccaaacattaccggtacttttccttctaacgctatttgagcgattccacttgttactcctgaacaaaccgattcgtaatgcgatgtttcgcctcgaacgactgctcctaaagtaattattccgtctacattacctttctggcttattttttgagctacgcgtggaatttcaaacgctccaggtacccaataaacatcgatagcttccttggaaactccattttgagctaaagtttgaaaagccccatccagtaaacgctttgtcactaaatcattaaaacgcgctactataatcgcgattttaagtttacttccattaaaagtaccaaaatattctgtcatttaatccattcctttcaataaatgatgcattttttcttttttaacttttaaatagcttcgattttcgggatgtgctgggatttggattgtcactcgctcctctaccttgattcccaatgtttctaattgtttaatcttgtcaggattattggttggtagattaactttcgtgactcccttttttcttagaattgcagcagctactccataatgccgttcgtcagcttgaaatcctaacttcagattagcttcaactgtatccatcccttgctcttgaagttcataagcctttaatttattagcaagaccaattcctctaccctcttggcgtaaatacaacaaagctcctcttccacggctttggatttcctttaaggaacgttctaattgctcaccacaatcacatcgcttggaaccaaaaatatcaccagttaaacattcggagtggattcgaagtaacaagggttgaacttcagatagatttcctttagttaaaagtaaagttggttcctgcccagcccccgtatcaaaagcttccatctcaaattccccatatttagtaggtaaatggactttcgcaaccgatttaactattccagcatctttcatataacgatatattttaatttcttcaatggttaatagtggcatttgcattccttcggccaaggatttaagggtgtttcgacgggccattgtgccgtcttttttcaaaacttccgtaatgtaggctactggccgaactccagctaacttagccagatcaactgccgcttcagtatgcccacctcttgctagcaccccaccttcttcagcaattaggggaaagacatgccctggatgataaaattcactaaatttagcttggggatccgctaacttttgaatggttttagcgcggtcaaaagctgaaatccctgttttagtggttttagcatcggtactgatggtaaatgccgttccaaaagcatcttccgcattagtaaccattggtgataatcccaatttttgagctatctccgcactcatcggtacgcacaacagtcctcgagcattggtaaccatcgtattgactgcttttggggtaacatattcggccaatcccaccatgtctccttcactttcacgattttcatcgtccgttatgataataagaccaccatttttcaaagtttgtagagcattttcaactttttcaattattctatttttcattatttacaccacgattttcgtttaaaatgtatttccctaaaatatcagtttcaacattcacaacatcattagcctttaaattacctagcgtggttacttgtaaggtatgtggaatcaaactaacttcaaacagctgcttctccaccgctgaaaccgttaaactcactccatcgatggtgatcgagcccttttcgaccacgtaatctatatagtcaggattaatttcaaaggttaggacgattgaattttcatctaacactctgttaactaatttggccgttgtatctacatgtcccaaaacaaaatgaccatctaagcggtctgtggctagcaaagccggttctagattaacttccattccatctttcatattcgcaaggctcgttcgatgggttgtttcgggcattacttcgacggtaaatccttcgtttaaaatgctagtaatcgttaaacaaatcccattgatggcaatgctatctccaattttgctatgaatttggtgggtcatcggtgtggcaatcgtaatttgcgcggttgcttgattgcgtttaatctggctgataatgccttttgctttaattattccagtaaacatctatactctcctcagtctaaatttcatatctggccccaattccattttttcaactaactgatatgcattcgattgatatggtaattgagtagggttaaatatcgctggtaaccccgtcgctccgtaaatacgtggtgcaagatagacattaatttcatccaccagaccgcttgctaaaaactcggcgtgaatttgactcccaccttcaactaaaacactttgaatccctcgtttagccagtagcgttaggattttattgggggtccaccgatcagaaatcacttctacgttattcggccactgtcgtcgagttacggatgaagtaagtaataagattggatctgctgttttaaaaaacgcataatcttcaactttaagttgatctacatcccttatcaaaaccattcgccaaggttgctgataaacagcgatttggcggactgttaattggggatgatcaacttttaatgtgttttcaccaaccaaaattgcttgatattctgcccgtaattgctggctgtcttgataggcttctttaccagtaataatgctgcgttggttggcctgctggttaatttttccatccaaagtcatggcatactttacatttacatacggacgctgatgctgatagaaaaaattgtatttaacatttaatcctccagtttggtttaaaacttttatttcaattccagcatcccttaaaatttgaagtcctcgacccgcgactaatggattcggatctttttgaccaactacaactgctttaatacctacttcagctaactttttagcacaaggaggcgtcttaccaaagtgactgcacggctctaagctgacgtacatcttagcacctctagcttgttttagatcatctaagtgctgcaaagcatcaatttcagcatgagcagctccaaactggtgatgataccctttagctaaaaccacgttgttcttaacgattaccgctcccactaaagggttcgtccacgtttgatacttccctttctttgccatttcgaaagctaaattcatataatcttgttcactaatcaaaatcaccccacgaaaaaagccccacacaaaatttgtgcggggcatgatttttgatagctaaataagactccatacgagcatgcacgccaaaaagcgtacaaaagagtacgaaatttaaataacgtttcttctcccatccagactatactgtcggtcctagactctcactaggtccaccgctactcgcgggtcacggacttcaacccttggttgttaccgtcggtcgggaattacaccctgccccgaagaaatctattcagttttcgctctgtagtctacgctaagataatatattttgcaaatctgaaccttcactttaatctaaccactctataaaatgtgctgtattttctcaaatattgaattttaccaatttaagctttatcacttgaatgaaagcgcattcttttgcacaatagaaccatatctagaaaaggagacttttatatggcatatcattcagtaaatccgtacgacggacaattaattcgcacatttcctaatacaaccgaccaagaagtcgaagttgctttgaagaatgctgatattttttatcaatttgcaaaaactcaacccattgaaaaaagagccgaaaaacttcaagagctagccgatgagtttaaaaataacattgaccattacgctcgccttattacaactaacatgggaaagttgtttaaggaatctcaagctgaagttcaaaagacctctgattttgcagaatactatgctaaaaatggagcagcagctttggcagacgttgagtatcacgatgctccaggggttaaagcccacgttgagtaccaatcgattggagcagtctttatgattgaaccttggaacttcccgtatgctcaaattatgcgggtctttgctcctaattttattgcgggaaaccctgtcttactaaaagaccctagtatcattcccgaatgtgctcaagcctttgaggatgcgaccttgaaggttggtattccaacgggagcatttaaaaatttatttatcaattacgaccaagttagtcaaatcatcagtgatcatcgggttcaaggtgttgctttaactggctctgaaggggttggtaaaaagattgcgtccgaagcaggagcaaatttgaaaaaatcaaccatggaattaggcggaaccgatgcctttgttgtcttaaaagacgctgatttgaaaaaagcaattgaagttgctgctaaagctcgtcttagcaatgctggacaagtctgcacggctgctaaacgttttatcgtccaagaagatgtttacgacgcctttcttgaaggtcttagccagcaatttgcaaaacgtcggttgggagacccactagaccccgaaacaactttggcgccactttcatccaagtctgctcaagaaaaactaagaaaacaagtggacatggccttagccggtggtgctaaactactttggggtaacaacacgcctattaaaggccctggtgccggcttttatcctctcatcattagtggtatgaaatcagataacccgatgtatgatcaggaactatttggtccagttgctcaagtttacaaggttaaggatgaagaagaagcgattgaagttgctaatgcttctcaacacggactaggtgggaccgtattttccgaagacttagaacaagctgaacgagtagcttcgaagattgaaacaggccaagttgccattaatcaattactaacttcatatcctcagttcccatttggtggagttaaattctctggttacggacgtgaacttagtgatttaggtattcgtgaattcattaacgcaaaaactattatcgatagttaagtatttttgttggaaatccggtataattgtaagcggatacaaaaactaatttccaataaatctacacatgttagcgaggaatatctcatgaaaaaagacttagttattaatgcgggcagttcaactctgaaatggaagttgttttcgattcctgacgaaacagtaatcgcaactggattgattgaccgaatcaatcttcccaactccgtttttatggttaaacgcccccatcacgatccttataaagtagtaaaaccttcaatcacctatgatttagcggttaccatgttactttctttccttaaagatcatggactagtcgagcatttacgtgagattactggaattgggcatcgcgttgtcgcagggggcgaacactttaaagactcggttttaatcgatgatgaagttttagccgaaatccaaaatttagctgaatatgccccacttcataacccggttcaggcccgctacattgaaatttttaaacagctcctgtcagatgttcgtcaagtggcggttttcgacacttcgttatacgctgatatgccgaaagttaactgcctctaccccatcccttacgaatactacacagacttagggattcgtaaatatggtgcgcatgggaccagtcatcggtatgtcgccaatcgggcagcagctcttctaaaaaaagatttaagcgatttgaaaatgattacgtgtcatctcggttccggttcatcaattacggcctttaatcaaggacgtgtaatcgatacctctatgggattcactcccttaggcggggtaatgatggcgactcgatcgggagatttagatccatcactggtcggttttctagctgaaaaattagggattagtgttaacgaagtgattgatattctaaatcaaaaatcagggttattaggaatttcccaattatctcctgaccaacgggatttggaagacgccgaaaattctaatcctcaagctaagttagcattggaaatgttcattaaccgcgtagtccgttttattggtagctatgtggctgaacttggtggattagatgctctgattttcactgctggctgtggtgaaaatggaattgcaatgcgggaacgcattatggaacaacttgcctacttcggcattaatgctgatgctgagcgtaataatgtacgtggtaaagaacaacagattaatcaagtaactgatgcggttcaagttctcgttgtaccaactaatgaagaattaatgattgctcgcgatatccaacgaattttacgttaaattgaacttcaacccccaagcttgtaaataagcttgggggttttctttactattttaatcatttataatactatatgagatatagtattatggaggtgaacatatggcaatccaaattccaaccgaattgctagacggtagcgttttgggaatattaaatcatggagattactatggttatgctctgacacagaaagttcaagcagactttccgatttctgaatcaaccatgtatcctgtcttacgccgtttaaaaaagaataattatttaacaacctatgatgaaccctaccaaggacggaatcgaaggtattacaagataactcaagcaggtaaagttcgtttggctgaaattcaagcagaatggattaccttcaaaaataggattgataaattagtttcaaggggtgatttaaatgaatgattacattgaagaattagagtcccatctatctccactcacgcgcgcagagcggtctgatgtaattgagttttatagcgaatatttacaagatagtagcttagtaagctatcaacaagcagtttcttcattaggaacacctaaacaattagcacggaaaatcttagcagactattctattaaagctggtgaacaatctgaacccgaatcgtcggattttaaacgtccacggcaggatgttaaaaccatttggttgatcatcctggccattttctctacccctattacaattcctctagcgctaggcttatttatggccatatttggtgttatttttgggatggttgttgcaattcttggagttggattggctttcactatctttggcattattgctattattatttttattattggtctaactcttttggcaacatccttttggactggtatttattacatcggttttgggttgttagtgattgggatatatttaattttaattccatttatccgatggatattaatgttaattcttcacgggacttcccttttcttcagatggttatataccaagattgtcacaagaagaacagaaaaaagaggtgatcggtaatgaaaaaaacacttatttcggggattatccttaccattttaggagccgtccttttaggattaggcatcttacatcacggcgatcataatttaatttggcatgatggcggatttaaaatcgaagatgcttcaatcaaacatgctaccttcaaagaagttcataatttaaaaattaacgccgatgatgaagttcaaattaaaccttacgctggatcccaaattaaagtcacttatcgaggaaccaatacccttgattaccaagcaaccgaccatcaactttctattaacgataattcaagaaatggttttacctttaatctaggacttggaaactttgcaccgtctacaattactatttacgtaccaagtactagtaagcttaacaagttaatttgtaacactagtggtacagtttctattactgatttgaacttcaaccaaatccatctatctccaaatgaagatgttgatttgcacaaagttaacgttaaagacgaactccaagttagtggttactctgatttagaattacgacaagtttcagcagcaagtcttgcttatgatagcagtgatggcgatgttactattaatgactcaaaattcattaagggctcatcaaaaattttaacttcagatggtgatcttgaacttaatgattctgacttcaaacagcttaagttagttagtgatgacggcgatctgaacttaaatcggcttagtatttcagaatctttaaccggtcgtactagtgatggcgatattcatactactctgaaggattcccgtaatctagcaattaatgcagatagcgacgacgggcacgctaaaatttttggtaaaaatacaaattactatcatcaaggatctcagaaaactcattattctttcactagttccgatggcaatattatcgtcagataattaaaaatccgccttttaaaggcggatttttttagttgaacaaggattcttggactgttaaagttctttcatcaaaatcgacggtagcttctaaattgtagggtattactgttcggggataagcatgcccaaaatttaagttaaacataattggagtttgataaaccgctgttacctcaagtaatattttttgatattcgttaaaatagatttcatcttgtggctttccaacaattatagctgaaactttagatataattccaaattgatctagggtttctaataattttcgatactcttttggcgtaggtttctcttcacttgtttcaataaacagaatttttcctaaccatttttcgggttcaggtaataggccatatttttgaataatagctggttgatcagagtgaccttcgcctaagacacatttacccaaactattcaaacaaccgccgaataatcttcctgtaactttcccttttccacgaagtacaaggtaaccatgtttttcatcatgtttaacacgtggtgtgttcagtgcttttatcgagaaatcgacccgttcatcataccaaattgggctagatttaatttcgactggaatttcgtttttcaaatagctagcaaaagttgctcgtgtataaggcaacatctgcctatctagctcgcctaaatcattcaataggtttggaccataatacgttattagccccagtttatttagtattaaatgattgatcgtcgtatctgaaaagcccgtaaaaattttaggatgcgcctgaactgccctaataaattcttcatcttccatcaaatatggcactaaacgataagtatcatccccaccaattgcacaaataattcctttaatatcggctgtcataaaagcttgtttgagatcagcagctctggcctctggatgacattttaagtattcaatccctcgacaagcatttttcataatgattggttgtaaaccaaattcttttagtctttgtattccttgcttcaattcgtgttcagcaaagctttcacccaatactccactggatagactcacgatcgctactttatcaccgcgtactagtgccttcggttttttcattacctctcacctcactttaacttcacctgaagttgaaattatcgatcttatttttctgcctgtattattcaaatatttagcgcccattataagccaaactgtctaaaaattcatttaatattcttaagtaactttaaaagctcatccattttgctcgtttagtttactaaaacatgctaacttatatccttaaggagatgactaaatgactttcataatcacacgatttttttggctaacctctgccttcttcaatactgtcctaggaataatcggcttagcgctaccagttatgccagcttctccattcttcattctcgctttaatctctgtaaaaaaagcttcacctgaaactcaccaacgtatcattaagacccgaccatttgtctggttgcaaggcaaatttccaattgtgggaaaatggttaggataaataaaaaacgcctaaaaaggcgttttttatttgttcatataatttgaaatattttctcatacttttgtaccaaactatcttcaaatttttttaatatcgatgttatttttcagcaaccacattacttttcaaaaagcttatacttatcttgcctaacagtattttttaatttcaattgaactttaactataggttcaattttatcactgttaacttgaaattcttcttgttcagcttgaacaacattaacttccccaaaatagtaaaaatcactaccttcatcatcatttttcttgataaataattggatagtcgtgtttttatttaatatttttttcatttcattggaatcaattttaacattgtgacgagtgtaccactggaatatatctctattaataaatttatcttggtatttaatactatcttctatggcatcagatttagaataggttacgaagattggacagacattttccttaactttatatccgtacacggttgaactgtctccttctgtccaccctatgattcggcaaacgtcttttctagaataccgctgatataatgaaaaaggttttgttatatcgtattcttttgcattttccagtcccgcctttatcgcatccaaaactaatagtttgaaatcgggattgttctcgaaactattcttgaatttttcactaatttggtagatattcttgttatcttttactatttgttccattccatattttttccgattagcttttttaaaaaattccaatgacataacttgttctacagatttttctaccgattcattataaaaaattcccttttctctaacagactttataaaatctccctttactaattgtccatcacattctagaatttcttctaataatagaagttcaacaattctttttccattcgttaattctgcagaaataaaagttaggatctcttcttcagcatgagtcaaatgaaactcttccttcattttcagcaaaaactggtaataatttctatatttttttataaaaacggaactatttactgttccaaaagattgaaaatctaataagaaggggactctccctaaacgtgcttttaaatcttcataatcgtcatgcaatatcttcatgctatctaaagatgtattatttatagattgataaatcttttcttttgcaatatccgaaaaattaacagtggatatccccgcaatttcatttaattccaaatcatctcgtgcactatttttatcccgcgacttatcaccaactagtgcaatagggattaggtagttatttttataatttccgataaaatcaatgactgttacatattttttattttctgattttctcaatcctcgtcctaattgctgaataaaaacaatactagattgtgtgtttcttaacattactacctgatttacacatggtatatcaataccctcattaaaaacatcaactgtaataatatattctattttccgttgttccagttcctcaataatcttttcacgttcccactgaggagtttcacctgttaatgccttactaggatgtctcttcaagctaagtgtttccgctaatctcttggcttcctctgttctactacaaaatattagaccttggagagcttctcctgagtaactgtaatattcagtctgtttaataacgtaatctacacgatcttcagatactaaccaatttagttgactagtgtcgtcagtaatttgcccatctacttcatagtcagtaatgccaatataatgaaacggacataacatgttctcatctaaagctttttgcagtctaatttcgtatgcaatgttgtagtcaaacaattcatataaattaaaattgtccattctgtctggtgttgcagtcattcctagcataaattgtggagtaaaataatttaacacttttttataagattcagctccagcccgatgtgtctcatcaactaagatataatcaaattcatccttatcgaaacgttctagccaattgtctcgcgaaagcgtctgtatggtagcgaataggtatttcccttcaaaatcttttgaatttccggatacttttccaaaagcctctgcaggttcattgctaagaatcttcttaaaactggatatagttttatctaaaatttgttccctgtgtactatgtatagaaatttatcagggctaaatttttttacgtcaaatgcccccaaatatgttttacccgttcctgttgccgagataactagtgctctttgagctccattagatcggatattttctatattagttaaagcctcttgctgcattaagttagggttgatctcttttgaagtttcatactctggaatttcttcttcaatttttgcttttaaatagcgttgttggcttttttcatatttaattttgtacccttcgatccacttttctgttaaagagtgtgactttttccactgattttcaatttcctcaattatctttctagtaatttctccatcctggtaagatgtaactctaagattccattcataattagtagctactgccgcttctgtaagatttgaactacctataattgcagtttggtaaacatcattatgattaaaaatgtatcccttagcatgaaaagtatgaatatctgcaattctaacttctacattttttaatttttttaactcatagaacatttttggcgaattaaactccaaataatcggaagtcagtattcgcccctttatacctcttcgagctaaatcagccagttttacttttaacggtgtaagagcgccttctgtaataaacgctattacaaagataaatgatgaacaatgaataagctcatgatcaatatgatcacgcattgtatctcctttagcatttaaaatgaaccgcggcaccatttcttcgttcccaataatatctttatccacaaaaccttgtgtcagagcattttgaatttcattttttatttttgttaatttcatccgaatttcaccttcgaaagatcagctttacatatctcacccactgctaattgatcagcatctgcccattttactgtttttagctcttcttgggacatccattctattttactatgagcaattagattaaaattatgagttataaattttgcatagtatactgtaagatttacagtcccaaaatcatattcaaaactacttgtatctgttaccttatcaccgacttgtatgtcgtcattaaattcttcaaatagttctcttttcaaagcttgttctggagtttcacctttttcaatttttccacctggaaattcccaaagcgttcctaaaatgcggtcatcgctacgtttagtagctaaaattttatcatcttctataaaagcagctccaacaacatcgatattttttttcataagtttataccccattcatttcagactttacttatattataactttcaaactaccaattattttatatctttaagtttacaaaaaaacaactttcatcatggaaagtcgtttcttctaatattttattaagcgtacaagcatattattgaattctttatttatgatacggacttcccgcctgaatcataaacgaacgataaatttgctcagttaacactagtcgcatcaattggtggggtagagtaaagcgcccaaatgaaatggcggaattagaacgtttcattactgcatcactaagacctaacgaacccccgatcacaaatgtgatatcagagtttccataagtagttaatttagccatctctgctgataattcttcagaagagcgttcttttcctttgatttctagggtaaaaacatagtctcgatctttaattttacctaaaatacgttctccttccttaactttaacttcattcatttgagcatcgcttaaactttcgggtgctttttcatctggaacttcaataatttggaacttacaaaattttgacaatcttttcgagtattctgctatcccctgtttcaaatatttttcttttaactttcccacaacaataattttaatattcacttcttttgcacatccttttttaagttattaacaaagttatccacaggctaatttttacactcacaacatattgggccgaatttatgttcgacactacatttgtggataagattttgtcaacagtttttttagttatccacaattatccaacttaatttttgtttcattccacacgcttacatcgcctacaaataagcgtttttatcaatataaaattattataaacttttttatccacagttatcaacactacctgtggataacttttcgacaggccttaaggtttatttaataacttttgtgtataaatagtttcgtacttttttagttattaacaaagttatccacaattatccacatttttttgctccgaagttcatctgtagttaaaacacgcttcaggattattctccatctcttaatctagtggtctcttaaaacactttttcgcaaaaaaactgcaactaattttgccatattagattagttgcagcttttttattgaatttctactagtcgtccaatcgataacaaataaagatatttttcattaactggtcgtttcaaaatgctctctaaggcttgtgcgtataaattgacctgcccttggtatcgattaattactttttctataccttgttcgacgctccccggaagaacaaaatcggtcttgtagtctaataagataactcgatcttccatttcgaaatatgcatcgataataccatgaatcaacacatcgtcatcacctttaactttagggaaaagtcccttagccggtagtaatagcgaaaaagcttcttcccgatgtacattttctggatggttgatcattagctgtcctaaatcactatcaaaaaagtctaatattgttgaaatacgaatccggttagcaacttgttcatccaacactcggttcattaccaactcaccaattttatctttaataattgtttcattaatcggttgattcaaatctaattgttgcaaaattaaatgcgttgcggtccctatttcagctgccttaggctttgtcgcttcattcataaaacgcggagccattaaactttccgttacaaaccgattttgtggtttaatgtgttgatctgcatcgacctcactaaaattcaattcgaatttatcaggatcgtcaaaaactcgcttaatttcagatactgactgataggcggttgtcatcgttgcggcttcatcatggtatttgaagttcataatttgtttaaacttatcaacatcagctatatcatcaaaagcgtttaactgctgtaactcaggtatctgcgctgactttaaagctgttaatccttgctgatccattaactcactgctattaataatcttcaattctacatccggaattagtgtaccttgcaattttcgggtattgtaatctgcgtatttttcaaccacagaaggtactcgcataattgccattccaatccaatctaaaaagttacttactttagatctagcttccgcaggaatcaacgtctcgtccgtgtctaccgcttcggcccacttgttcaaggtgtcatccgcagaattaactgctccagtgataattagcttttgttctgcgcgcgtcaaggccacgtagagtaccctcaatttttcggccaacgccttttgcttcttaattgaaataatccaattcttttggactgtatcaatctctaaccgatgaataaagtccttcaatgtgattcccattcctgcgtctcgatcaagaacgtaacgtcctttctcatccatggtattgaatccatgttcggcatcaattaggaatacaattggaaattctagccctttacttccgtgaatcgtcattaatttcacagctttgacatcagtaactactggattttcagctaaatccttattcttatctcgcattttttcaacaaatcgaacaaattggaagagtcccttaaaactagactcctcataccctttcgcccgatcgtacaaagcatgtagattattttggcgctgtggcccatcgggcattccaccaacataatctagataacctgtctcatcataaattgcccataagaggtccaccaaagttgattgacgggctaatttactaaaatgatctaactgctctaaaaagtgagttatttttgtttttaactgcatttggaactcattattagaatctagcttggcctcattcaagaaataaagtagtgcctcaaagtaatgcccatttttctttccaattcgtaaaaaggctagttcattttccttcagccccaccattggcgaccttaaaactgctgccaatgggatatcttgatagggattatcaattattttcaataacgccatcatgattgaaacttctgtggtttggaaataatcctgggcattattaacttgaatgggaattccatatttcttaaatgtatcaacaatctcaaggttattactacccgttgagtgtagcagagcaatatcgctatattctaagtcccgcattttttgttcttttttatcataaatctgagtatgatccgcaaatagtttttgaatacgttgagcaatcatctgtaactgaccgtcatttttgtttgagataattggagtagcttctttatcatctatatctgtttggctgtcgtcataaatcattacctcggtgttattctgaacttcatctgggtagtattttgcaccaaattgcaattgtgcatcatcatcgtactcaatttctcctacttcagtatccattacttggttaaaaattaagttagtaaaatcatcgacatttcgcatcgaacggaagttttctgctaaaataatccgttcatctgcttgttcttcatctttaaattgattatttttactaataaacagactaggatcggccattcggaatgcgtaaatagactgttttacatcccccaccatgaacatatttcctggatctgaactggcaactgacgtcagaattgtttcctgaagcgggttaatatcctggtattcatcaacaataacttcattaaatttttgttgaaagtcgcgtctgattgcttgaccttcttcagaatcatctaaaacaatttgtaacgcaaaatgttctaagtcactaaaatctaaagaacggcgggttagtttttcctgtaaaaagtgttccgcaaattggttttgtacttcaattaacttcatcattaaatcgtgagcatccttgaagaccgcaatcatttgctcactagataatttaaagtatttatccgcaattgtattaaactcatctttaaaatcatttcgaattgatttagcgtatgcattaaattcttggacttcttcttttttacctcgtggtagttgcgcaaacttcatcttgctaacggcttgttgtaaatcatcccaactaccatctaagctgtcgataatagtttttaaatcatcaacttcattttggaatttttcagctgcattttttaaaggttctccaccattgattgcttgttctgtaagatctaggtctttgcgataaattctcatcaactttgtttttacttctgttaaaagctgttggataaactccatatccataacattatcagatggaacttcgtaatttttagcaatctgctgtaaccaagcttgagggtctggattagcattcgaaaactcaaataattctaaaattaaatcttgcagcccctcatccgaacgatcgcttgaaaaattacgcgtgaggagcgcaaatttaccatcctcatccctctcgtataattcttcccggagatccgcccagacactttctttcaataactcgctttctgttggatccataattctaaacgtgggatctaaatcaatgatgtaataatagtttctaactatcgacatacaaaatgcatgaagtgtactgatattcgcgttattcaacttattaagctgcattgaaaaatgattttgaagttcaatatcactcacttcattaatttttttcacaatcgctgctcgaatacgttccttcatttcactggcagcagcttccgtaaacgttactactaatagacgatcaacatcttcaccattaataattttttggattacacgttccaccaaaacagaggttttacccgatcctgccgaagcagagactaaaatgttgtggccggaactattaattgcttgcttctgacttaaggtatactctctatctgtcattcttttcctgttcctcccgaatctgttctagtacttgatctttatctaacttatcaattattcgataattattctcaggtaacatcgcatcaaattgcatgacatctttataaggagaatattccatcactgttcttcgattaggccactgtaccggattcatatctagctcacccttgaaaatcttttctccagcttcacgtaccttcaattctgcatgtttaatcaaattttgaagttcatcttcgcttaagatactattttcactaaccttcgttaaagctcccttagtagtaaatgcaattggaaatacatcggactttctggtgtcttcaatcgtcttatcaatttcctttattaattcctcatcttttaataaaaatccatttagtgagaattttttgaatatgctttggttaagttggttagcatcgctgcccttccactcttttgattttagaagcgggtactggaaaatcatatataatgcgctcgaaatttctgcttttgtagctgggtcaatcttttctttattacgctgaactacatccaagtacattaacatttgcatcgctaacccatagtaagcatctgtgaaatcaaatttacggttactagatttgtaatcgacaattcctaaatagtccttatcgccaatttcaatcttatcaatacggtcaattttaccgcgtacgttaatttccttgccttctccaaccttaaagttcaatgctggcaatccagattgcgaaccaatctgaccaaataattgttccgatgcaatcggacgcattcgtgtgcgagccagttgtttaaagattgcttcgaccatcgcttgcaccgttcgatctagctgttttcgcaaaaatcccatccgataagttccattaaactggtcaaattgttgatcttgctccatttgttgaactaatcttttcgcaatttgttcaatctgttcttgattaacttcattgaagttcagattctcagtagtaatcattttaattagtttatccattgccgcatggaaatattgccctgtatcagcggggctcaaatccgatgtttcccgttcttgtaacttcaatccatattttaaaaagtatgaatattcatttcgataaaactcttctagcttcgatactgaagcataaattgtatcgccgtaaagaccttccacaatttctggtttcaatttttcggggatatttttatattccagactgcttagtaactgatctgttaaagaacccaatgtactctgtctcaaaattgtataaattagattccagcgtgggtctgcttcacttttagcttcatgcatggctctcgcatactgaattaaatgactcaatgtacttcgattggaaccaataaatagctcgataaatggtggatccagtcgaactggctcagttgtaggtcgacttggtaatgattgggcgataatcccaaaatgtttaccaatccgttctacgtaaggcgagatttttaattctacgccatcatttccactttttggataagagaaaattaactcatctgaaccaatcataaatgttagataattaaggtatggttcttggcgcatctgtcgatcattactaattctcaaaaattgatcatcatctaagaacggatctatttgatttttaccatcttgattcaaaaaatcattatcttgaatttgttccggcattactcgatcagtagctccgatgataaatacaattttacggtcaaccatctggaccattccactttctgaaactagaatttgatctagtgtagatgggatttgcgaataagttgccccttcaaatcccgcatttaaaagacccataaaattatctgggtcaaatggctgatctcctagaatatcgacaaattcatcgagcatctggataaaagtttcccaagtttgttcgggctcagcagctttcgccaaacgcccttcctcaatccattggtctcgccaagcaagtaagcattgatcaattccatttttaattaaaaagtcatacaaggccttggctgcttccacaccagtggttgcagtagaaagttgattaaaaaatggcacaactgtttccgctacataattttttaccgtattaattcgctgattaatttcgatttcttcatccgtttgcttctcttcgtcaatatcgttaaaacgactatatttccaatcttttttctgaagccatcggtctccatagattccttgttttaaaacgtaattttcagtaatatgcacactcttgaagaagtccatcccgtgcgggtcatcctcagtttctggaaataacaaacccgtttttaatagacgcattacatcttcataacgaaaatgatgtgctctaatatcaaacaaagcgttaatcaattctagtaatggatgatctttcattgcaatttgaagatcataaaagatcggaagctccatttgatcaaatattggcttaataatcgttgaatagtcactcaaatgtcgggttaaaactgaaaaatctgaaaattttaaacttggatctttagccattttttggcgtattaaagtcgccacatgttctacttctgcataacgactattcgcttggaaaatcgtaacacatgcgttattttcttgtttagaacctcctacttgaccttcacttgattcgatccaatatttttctaattttaaaagatcagaattaactctaactcggtgtaaacgaactggttctagcgatttcaccttgttttcatgagcccacgcattaaatttgaaaattattttttcgttttcaaaaaacaaactgttttctgaaactttttcataaagcggaaatttatccattattaaatcaataacgacatttccattggccttcattaaggcttgaattaaactcatttcttcagcggtaaaatttgaaaagccactaattataaaactctgaccactcagatccattttagataattcatctgttaaagtatgcgtaatatcgctagcatcaatgaaacggctttgaatttcttcttcataagcactataaattatgcctaagtcatgtaatttagccttaatatccatccctgcatcgctgttttcggcaatattttccgcaactcgacctaattcgtcgggccctacattcccttgcttgaattcagctaactgcgttgcaatcttctgtaccagccccaactgagcatctatattatgaaacaagattaattcatcttgatgttctaaaatcactctatataacagcatattagaactagagctcgttacgcgaggatattggtaaatactactgtttcgcaagaaaaaccaggctaatcggctaaccgaaagaatttgaacatccttttcggcaaaaatatgacccttaacttctcttctctgtcgcaacttttgaagtaattgtatttcggattgaaacttgatgtgattaggaaccaaataatatactggccgaccgacattctgttgctgaagttcaattaccctgtcggcaataccttctagatggtcaatacttgctggtccatacataaattgaagtggcatattttctcctatcctttattagaaattccaatcgactgattaatataattattggtcgtaattgcatcaataaccaccgttcttaagttagcttcactaactctatctacgctaatcttttctccttcaggaattatatttaaagctacattctgaacttcatcactaacttcaaccggtcgtaaaattgtatatggaagctcagtctcatccactaatttagccacatatttgacttctaatagtagttctttcaaatcttgaacttcaatccagtttggattgatttctttatccatgccagccgttgctagaaaaataattttgttcgctttaatttcaccagcctcaatttgatcaataattccttcaaattcttcatccattccgaggtgaagcatatcaacatacattacatcataattaatcgccgcaatgtttttaacttgctttggcgtacatataattactgaaaaatctgatttttgttttaattcttctaaaacttttttggaaataactcgttctgttccaattgctaatatgttcattgatttctcctaaaaatagtcttttttacattataaatctgtttgtttctttctccaattttttcgacaataactattctagtttgagaatggttgtttcattaatttttatatgttaaaatttcagtcacaatcaaataaaacttagcctatataatgtcttaacctggttgacagtttctacccaacgccgtaaatgttggactataggaaaactaactcttatgtattatgatggcttgagactttttgtcttgagcttttttagttttataggctcgatttcatattgatttgaaaattatgaaaacgaggatgagaattcatgaaaacaactgaatcaagttacaccgaagttcctgtaactgaaattaaaccacaattaactgaaggaaaagctgctattttaggctttcaacaccttttagccatgtactctggcgatgttattgttcctcttttaatcggtggttttttacattttacagccgctcaaatgacttatttagtctctgttgatattttcatgtgtggtatcgctacgctcttacaaattaaacgcactcctctaactgggattggtctcccagtcgttttaggttgcgccgtgcaagccgtccaacccctccagcaaattggagggactctaggggtcaccgccatgtacggagcaattatcgcttctggtgtctttgtatttctagtcggtggacttttctctaaaattaaaggacttttcccaccaatcgtaaccggctcaattattaccgtaattggctttactttaattcctgtggcctttcaagatattggcggtggagatgttgctgctaaaagttttggagatccccgtaatctattagtaggcttaatcaccgttttaattattgtaggtattaatgtgtgggctcgcggttttttccgttctatcgccatcttaattggtattttaatcggcaccatccttgctagttttatgggcatggtttcgttatcgcccattgctgaagctagttggtttcgaattcctcaacctttctattttggagttcctacctttaatctttccgctattctaaccatgattatggttactttaactacaatgattgaatcgacaggggtctttttcgcattaggtgatctggtaggtaaagaaattactcaagacgatttaaaacgtggataccgttcagaaggaattgcagccatccttggagggatctttaatacatttccctactcaactttttcggaaaatgtaggtgttctccagctttcaggcgttaaaagccgtaaacctttatattatgcagctggtttccttattgttttagggttacttcctaaggctggtgccactgccaccattgtgccgaccagcgtcctcgggggagctatgttggtaatgttcggaattgtcggggttcaaggggtccgtatcttacaacaagtcaacttcaaccagactaaaaacattctaatcgtttcgctatcagttggtatgggacttggctcaaccatttatcctcaactttaccaagcccttcccgctactattaaaatgctacttaccaacggcatcgtgattgctagtatcactgctgtcgttcttaatttgttatttaatggctacgatcgggatatgtaagatgtgctaaaattgaattaattaaactaatgtttttaattaccctttcaaagggagttaaaagcatttttatttagaattggagaatgcaaaatgaacaataattttatctgtacgtgggctcaaaatgcttctgaactcatgcaagaataccatgctaaagaatgggggcaaatctcccatgacgatcgttacatgtttgagatgctctgtttagagggttatcaggctggtttaagctggaatacaattattaataagcgtgcggcctttaaaaaaggctttcataactttgaagttcacgtagtagcagccatgactgaagccgatattgatcgattaatggaaactcccgaaattttacatcatcgaggtaaattagcggctactatttctaatgctaaagcctttattgaagttcagcttgaattcggtagttttgatgaatatatttggaaatttgtaaataaccgtcagattaacgaccatattcgaattcctgaggaaattcacgccaaaaccccactctctgaaataatttcggctgacttaaaaaaacgtggatttaagtttgtgggtcccgtaacagcgtactcatttatgcaagccattggattaattaatgatcatgaaatagaatgtatgtataatcctggttaacttaaatcggaggcttactatgaatcaaatcatccctacctcggctaatgggtgcattcctaacgtctattttatggggcgttggacaactcagaccgttgaaagcaagccagcaatgtataccactaatctaggcgctcaaattttgtttgaagttcaaaatgctgattatttcactttagaagcggtaattaagcctctttctgctcctcaaactctaagcatttatatcgatgatgaattacatttaaccccactcacccagtctaaaaatgactttaaattaagttcaaatcagtctcatattgttcggatttattttacaggcaatactgaccaagatgagatttggttaggtaatgacggacttaccattaaagatatcacgattgcttcaggcaccctagcggctattaaaccagctggaccactcgttgcttttattggtgattctatcaccgctggctgttgggttcgtagtaaagcaccttctatcggttatggagccgaccttaactatgctgctcaattatcccgcgctttagattgggaagattatcgtattgcctatagtgctgccggtataatccgttacggaacgggaggagttcccccagctggtaagtttgtaaaatatgtcaattttagcgttaaagctcctcggattaatcctgatttggttttaattaatcttgggactaatgatgctcgctatgaggatgacgtttttgaaatgtactttgtttggtttataaatgaagttaaaaagcaattccctcatgccagaattattataattataccttttaatcaggcacatgctcacgtcatcaagaacgtcgctaaagccttaaaaatcgaacttattccaactttagattgggtaattgaaacaaatgatgaagttcatcctaacgtagaaggatcaaaagcaattagtgaccatttagtcgcttggtttactgaacctcaaaacaggttacaatcggagtaatattctcctcttgtaacctgtttttttaatttcgatgtttgattccgattcctgtaaaaccacttaaaattgagaatactggagacaacaagctaaagaatacgaatggtaggtaacttaaagttgctacatgaaaagtattggccgcgaaagtacctgctaccccccatggcacaatgtaattaattactgttccaccatcttcaagcgcacgacttagtgtgacgtttgctagccctgagcgttcaaaagttggtttaaatgctttcccaggtaagatgacagataggaattgttcaccgatgaataaattcaccccaattgcactagcaattaccgctaagattagtttcccatcgctatttaaacgttgcgcgattggtgccatgatttgttcaattaagcctaagtgtactaaaataccacccaaagataaggtgacaacaatcaaagctacggttcccatcatgctagcaatcccacctcgagttaatagctgatcaacgtctatattaccagtctttgaaataaatccattttcaataattgaggcaatttttgttactgtaatctgaggattgccgataaaaacaaatattacagaaaccccgatattaataaatagagttggaacggcaggtactctcatccaagcgcagataaacattaaagcaattggaataataacccagaagttgacgttgaagtgctgttctaaaatagccacggtttggttaatcttactcatgtctgcacttttagcttcgcccatccccattatcgtaaataaaatcaaagctcccacaaatgctggaactgttgaccacattagatttttaatatgatcaaataggtctgcgtctactactgcggccgacaaattagttgattcagaaaggggcgaacacttatcaccaaaaattgccccagaaataattgctccagccacgagggccggattgactcccatggtgactcccataccaaaaaatgctattcccaccgttgacattaccgtaaatgctgaacccacagcggtaccgactagtgaacagacgataaataccgaaggaacaaaccacgctacatttatcaacttaaaaccaattaccattaacgtcggaataataccggctgcaatccagacactaattagtgccccaactaaaataaaaataaagatggggataatccccgtttcaattccatttttaattccttgattgatatcttcccattcaaaacctcgtagcttagcccacatcgttattaaacctaaaactaacaatactggcgtttgaggagataatttaaatttaattactcctagccccattatcactaacattaaaaccaataccgtgctagtttctaaaatactaacctttttcattccaagtccgccttattttgaccaaaaaaatgtccctgctgcatcataaatgcaacagggacgatatggagaccgtggtaccacccagcttaagagaacccaaaaagacctcttcactcactagattgataacggttctagttattttccgttaaattaaactattccacggtatttcgacaacataaccctgatcggttcgcagcaaccaccgactttctgacacccagattatgcactacttaatgtgaaagttaaaatgctttaattgattttttacaagattatcacgggttaaaaataacgtcaactctttttacttacaaaattggtgaaagcaaacgtgaaaaggtttgtttgaacttcagccacgtggattgtttattaaacatggctacggtttggagactagaatgtttgatatcttcttcataaatttcctgcaattgttttgcaatattttcatcatacataaaggcgttaacttcaaaattaagtttgaaactacggaaatccatattcgcagaacccactgtagatatttttccatccactaccatcgttttagcatggatgaaaccattgttgtagtaataaactttaattccccacttagcacattgccaagcataatattgggttgcacgatagacaaacgcgtgatcaggcatacatggaatcattactcggacatctactcccgatgttgctgctaagcgcaatgcgtccaagacactatcatctggaattaaatatggtgattgaatccaaaccgattccctggctttatgaatcattttcaaataacccattttaattttttcaatatctgaatctggcccattactaacgatttgaagactggtattgcctttaacttcagcgactgggaaataaactgatccagctttaaactcttcgacaatttgttttttacggtctgtagcattccaatccaggataaatcttgattgaagtccgtaaactccagaaccgatgattttcaaatgggtatctcgccaataaccaaattttttcttacggcctaaatattgatctcccacattaaaaccaccaacataaccaatcttaccatcaatcacgacaattttacggtgatccctgaagttcaatcgaaagtcagttaaagctgaacgtgtacctaaaaatggatatgcttctccgcctagttcattcaatttcttgaagaaacttcttttggtacctagcgatccccatgaatcccatagcaccttaacttcaacaccttcacgtgttttttcttccaatagctcgcgtaactgattgccaatttgatcatcataaattgtataaaattcaacgtgaatatgctttttcgcttttttaatttcagcaaaaatatcatcaaaaagttcatttccatctgtgatgatttgaacttcatttcttcgatttaaaaaagaataatccgttttagtaaagaattggaccattcgttctgaatctttaacaacttgatcggcagcagtaaactcattcttttttagctctcgacgctgatgctccataacttgatccaattgaaggcgagtcttacttttcagcggaaataatttgttttctggtagctttcgtcccacaaaggcgtatatcacaaagcctacaccaggcaagaaaaataagaccaataaccaggcccaagtagcagctatatctcgacgttgtctaaaaactgtataaacggcaccaataatatttagaataagaataatatatataatatcttttataatttgaaacatctaaatcccccattatactcgtatggattcatgatactatgtagatttaaaaatgaaagaacttttttattttagcctttttttaggactaaattttacccgttttgaaatattacattaaacccgataaactgtaatttctcagcaatcaaaaattcacactttcttcacaatttctttttatagtgacactatagataactttttcatttactccccccataaggtgaatgaaaggtctaacgaccagttacttattacctgtatatgcgtctctcccccctggtgagacgtttttttatttcttaaaataataaagcattcgatactttataaagtaccgaatgctttttaatttattttctaatccatccccttgaattgaggacgctccggaggtactaagaattggcccggaactggtttacgctttggatcttcattccagtagcgtggtatgagatggatatgacagtgaaaaacactctggcccgctgccgcacctgaatttactaccacattatatccatccggttggtattcttggtctaagatcgccttatttttttcgaccaatgtaaaaattgcgtgtctttcctcttcatttaattcccacaattgacggacatgccgtttaggtacgattaaagtatgtcccttactaactggataaaaatctaaaaatgacgctgctaatttattttcaacaatataatcttcctttgttttctggcaaaaaacacaattcggatcacgcttcatttttcattcctccacgattaagttccaagttaccaatctcttttactagctggtacgttaatttaattttagcgcttaccttcataaaaacaaacaaaaaaagctgcgactatctcacagctttcttagcttaatcggttgctaacttattgatatttttcttagcttgatcatttttactccaaaatggaaccttcacaacacccattactttagacttcttaacaaatccccagtatcgactatcgttagaaacacttcgatgatctcctaacacaaagtacgaatccttgggtacctttttaggactcttagcccagccatatttgttggcaattgaagctaaggtccagtttccagtccccgttgtgcgttgttcttcatcaataaatttttgaggaactaacttatcattaacatacaactttccatctttataactaattgtgtccccaggaacaccgatgacccgcttaacataatctacgggttcagtagctgccggatcttctccatgagcatcaaaaacaattacactcatccgcttaacttccattggtttccaaactaatactcgttcactatcttgtaggttaggttgcattgaagagccatctaccttaacaaattgaaacaggaatgttttaactagcagtgcaactaataatccaattacgattggtaaaatccaatctctcaaaaaacgcatcgatcttcctccaaacactttagtctcttaatgaatcttattgtagcccaaacttagttacttgtcttagaaattttacttttgaaatgaaaacttgatatttttatatacttttgcaatataactgttatatttgccaatctatgggtatttacctaccttcaatttaagttcaaaatttgtttaaaccattatttgtgaagttcatttttgataaacaccattttatcagcacttgataaatcggctcggtaagcatagtttaaacgatcaaagctcttcagttccttggtatttttaacttggttaagcgccataaaattaaccatttctcctcgagcttctttggctggagttgctttttgctttatctttccatcgataatttctccaaaaatacaagtagtcattttatcgccttcttgaagaaacggacgcacggctttttcatattctttagacactaaattaacgacggctcgattatctttatataaattttgataaagcttagctccccaaaattggtataagttattatagttgtctatttttaacctcgcttgcatttctagtcgatatgggacaatcccatcaaatggacgtagcactccgtaaaacccagatagaattcttaaatgttcctgtatataagacaactgcttttccgtcattaagtctggagccatatattgatattgaattccgacgtaagccataattgctggcgttagctgatattttaaatctaaaccttgcagacgctcataattcaattgagcaagtttatcgctacacttccataacgttttaagatctgagtacgtaagttgtttcatcatcgtcagaatcttctgggtttgcttcaaatatactggcatcgtcgtcgcctcaaaggaatctgtatctacttgcatcttcttagctggtgcaataattatcttcatgccattctccttttttactgcctattttagcagaactaacattaatttttttcagtttcacgtgaaacattcttttttgtgaaacaaaaaaagctccttgaatttttcaaggggctaatttttgttattctgcgatttttgcgatttttccttgttggatataaacactcaaaattgcaatgtcagctggcgttaccccgctaatccgtgaagcctgtgcaatggtagttggacggattttttcgagtttttggcgaccttcagtggccaatccattaatagcttcataatcaatccgatctgggatagccttttcttccatccgcttcaaacgatccacccgatcttgagcctttttaatatatccagcatatttagtttcgatttcgacctgttcaattactcgacgatctaaatctttttctggagcatcaatgaacttcaataagtcactatagttaacttccggacgccgtagaaattctgatgctaaaaccccatcttttaagccattagaaccctttgactctaggaattcttgaacttgactaggtttaattcgaatttctgacagacgttgtagttcatccttaatatcttgtttcttttcaaggaatgcattatattcttcgtcactaaccaaacctaagttatgtcccacttctgttaagcgtaaatcagcattatcatgacgtaaaattaaacgatattctgcacgactggtcaacaaacgataaggctctttagtacccttagttaccaaatcatcgatcattacaccgatgtaagcatcactacgtttcaacgttaaaggctccttacctagggcccgacggccagcattaatccctgcaattaggccttgaccagcagcttcttcatatcctgatgttccgttagtttgaccagcagtatataaattctttactagtttagtttccaaagtgttcttcaattgataaggtgctaccacatcgtattcgatcgcatatccgggacgcatcatttcagcttcttctagccccttaatggaatgcaaaatttgttgctgcacttcttcaggcattgaagttgaaagtccttggacataccattcgtcagttttacggccttctggttcaaggaacaactgatgacgactcttgtccgcaaaacgaacaatcttatcttcgattgaagggcagtaacgaggtccgacaccttcaatcattcctgaaaacatgggagctcgatctaaattctcgcgaatgatttcatgagttttttcatttgtgtaagtcaaccagcaagataattggtttttaagttcaatgtacttactatctggtgtttggaaactaaaatgattaggaacttcatcaccgggttgttcttcggtttcatcgtagttgatagttccgccatcaactcgaggaggtgtccccgtcttgaagcgctctaagtcaaagtgatatttttcggtcaagtttttggttaactctagcgcagcttgagaattgttaggaccggatgaatattgaagttcaccaatgataattttaccgcgagcagctgtccctaatgttagaacaacacttttagcttgataacgggcgccggtgttagtaataactcccttgcagaccccatcttcaacaattaagtcatctacaattccttgacgcaaagtcaaattaggttcagcttcgatggtctttttcatctcagcatgataagcatgcttatcagcctgcgcgcgcagcgcgcgcaccgctgggccttttccggtatttaacatccgcatttgaacataagttttatcaatattgcgacccatttcgccgcctaatgcatcaatttctcggacaacaattcctttggctggaccaccaatggaaggattacatggcataaatgccaccatgtcgagattaatggtcattaagagggttttattacccattcgagcggcagcgagcgccgcttccgagccagcatgtccagctcctactacaattacgtcatactcgcgaccttcatattgttttacttcagacatatttttcaactccaaatttattttcctaaacaaaattgactaaataactgatctaataattcgtcctggtaactatcaccagtaatttcacccaataaatcccaagcacgtgtcatatcgatttgaactaaatcaactggcattcctgtttcaatcccttcaagaacggcatctaaagctgtttcagcttgcttcaacaatccaatatgacgagcgttagttaccataatattattagaggtattttcaatacttccagcaaaaaacattgctgcaatacggtcctcgaggtctttggttcctaaaggtgaaacggctgatgatttgataatttctttatcatctacatattcttgaagttcatttaagttaatttttacttctaaatctgatttattaagcacgacgatccgctgcatatgattggtttctctcagcagctcccgatcctcatcgcgcagtggaacactactatctaaaaccaagataactaaatcggcttgtaaaagagctttgcggcttcgatccactccaattttttcaactttatcttctgtttcatgaataccagctgtgtcaaccaacttaagtgggactccttgaacgttaacatattcttcaattacatcacgagttgtaccagcaacatccgtgacgatggccttatcttcatgtaaaagatgatttagaatactagatttaccgacattgggatgcccaataatggcggtagccagcccatcacggagcactttaccttgtttagcagttgaaagtaattgttgaatcttcgctttaacttcaattgctttttctttaagtaaccgagctgtcattgtttcgacatcgtcatattctggataatcaatgttaacttcaacttgtgctaaaacatctaagatattttgacgtaaattagtaattaaatgggataaatttccatctaactgatcaagcgccactttcatcgattgatcagttttagcacgaattaaatccattacggcttctgcttgagacaaatcgattcgtccattcaaaaaagctcgttcagtaaattcacccggtttagccaatctcgcatctaaccctaaaataatctgtaaaattcggttagttgcgacaatcccaccatgacaattaatttcgacgatatcttccttggtgtacgtatgtggcgcacgcattacagacaccattacttcatctacttcatttccattttctggatcaataatatgaccataattaatggtatggctattcaccttattcaaatctttgccacgataaatctggctggcagttttaagtgcatccactccgctaattcgaataattgaaattccgccttccccaggtggagttgaaattgctgcaattgtgtcaaattcagttgaaacagtttgcataatgttatcctttctttttccaataaaaaaagcgcagttccacccataatccagttagccacttggatatagggtggacaaagcactttcactacttcatcatattcactttatacgaactacatcataaaatttaaagacggatttgtcaattttttattctcattaatctaatccagctctatgggcatcatatcactccatcatcacgttacttaaatcaacctgcatttagtccattaaaaaagcaatcccccctgcgaaacagttgcgattgctttcataaattattttcgtttactcttcattgctcggcgtttagctttttcaattgctttacgctttgccttttcagtttgaattttttcttcacgttctttttggatcttgaacggattctgaattataagtgtttgaccaacttggaataggttagttactacccagtacaatgtgatcgctgctgggaagtttaaagcagtaatcaaaattactagtggcataccaaacgtcatggccgatgtcattccattttgtgatccagcgggttgtgacttcatcgacaaccaagtactcataaatgtgaacaaggcggctaagatgggcaaaataaagtaaggatctttatcactcaattgtagccataagaaagtaccctcttttaacacttgggtccggctaaccgccgcatacaaagcatacataactggtaattggatgatcaatggcaaacatccagccatcggatttaccccagcttcagcataaagcttttgctgttcttcacgaagtttttgctgactttcagcatctcgtgatgaatatttttgctgtaactgttttaacttgggttgaagttcagctgttttcatcgttgttctagtttgataaatcatcaatggtaagatgataattcgaattattatggtgaaaacaataataccccaaccataattgccaccaaacaacttggataagtagatgatgaatctcgagaaattgtaaacaatcactccgtcccaaatcccagtactgtgactggtgatgggcgctgtgctacacgcagttaatatgaaggatagggctgccacactgagcaacgccatatttcgttttaaatgtttcactattcttcctcactttgttttgaagcaaacaaccctgctagcttaaaaacatgttccaattgttgtttaacttcattcattggtagtccagaagcttgtggacgtgctataactaaaaaatcgacgtcttgacgtaaaagaggcttgaattccaaaatgctttgacgaattcgacgttttgtataattacgcattaccgcattaccgatttttttcccaacggaaattccaaccctaaagtgaggttgttctggtttgtccatcacgtaaacgacaaattttttatttgcaaatgaattacgagtttcaaagaccttttgaaactcaagttcttttttgattcgatacgactttcgcattatttctctccacaacctatatatatatcactaacaaacattatatgtaaaaaagcttctattgtctctaaaaatttaaaaaataaaagaccactgggatcagtggccttattatgcagataatacttttctacctttttgacgtctacgtgctaaaactttacggccgttgcttgtgctcatgcgcttgcggaaaccgtgaacgcgttgacgatggcgtttcttaggttgatatgttcgtttcattatggtccacctcctgaacgaaaatacacatactgaatttttatatctattttttaattttcgataaatcagtttatgtcgtttaaacaattaccttaacataatatcatacctacagaataaatcaaaccacctattaggaaataatttaaaataaaatccaaaattttatccacaaacagagcgttagcttgtctatactttgtggataactttttaagtgatttcgacttatcaacaggctttttcgcagcgatttttttcgctcacagggtgtttatatagttatccacaaccttgtggaaatctgtggatatgttaaataaacgttgatataacaataatagttatccacaggtttctgtttataacttaaatttctacgaaaagagaattgcttgataacaccctgtggataactcagatcacagactgttatttaaccccatttagttatccacatccatgtggataactttatttttttatgttaaacttagtgagctaaaaattttggaggaattgaaaaagtgcctaactatattgacctttggaacaacattaaaaatagtttcgaaaaagacgactccatgtcaaaggccagtttcggtgcttgggtagaaacggcagaacccatttcattagaaaaccacataatgaagattaaggttctttcgagtctacatcgagattactggacaaagcatttgatcgagaagtttgtcgaatatgcctaccagttcactgatcaagacattacgcctgaattcgtaacggaagatgaattcaagacacagctggcggaaaggtccgctacctctaaaaaagaaaccaaagcttctactgaagatacccaacttaatagtagatatacttttgatacttttgttattggtagtggtaaccaaatggcgcatgcagctgcgatggctgtatcagatgaacctggcgttctatataatccgctctttttctatggaggagtgggacttggaaaaacccatttaatgcatgcgattgggcatcagttattagaaaatgatcccaaaactcgcgttaaatatgtaacaagtgaagccttcactaacgacttcattaattcgattcaaaagaataagacggaagagtttcatgagaagtatcgtaacgttgatcttttattagtagatgatgtgcagttttttgcggataaagaagcaactcaagaggaatttttccatacatttgaggccttgtataatgcccaaaaacaaatcgtgttgacatccgatcgcttaccaaatgaaattccgaagttgcaagaacgtttggtatcaagatttaagtggggactttcaattgatatcacgccccctaatttagaaactcgaattgcaatcttgcgggagaaggctcaagcagataacgttgaaattcctgacgaaaccttggaatacatcgctaatcgtattgattcaaatattcgtgagttagagggggcgatggctcgaatccaggcttacgctaaattgcaaaacgcagcgattaccaccgatttagcttcagacgctcttcgcagtttgaatttcggtagcaaccttagccatattacgattccaatgattcaagacaaggtcgcaaaatatttccatgttacagtagctgaccttaaaggaaagaaacggatgaaatccatcgttattccacgccagattgcgatgtatctatcccgtgaattaactgaaagttcattgcctaaaattggaacagaatttggtggtaaagatcatactaccgttattcattcctttgataagatcaaagctgaactagaaaaagatgaggaacttgctcgccaagttggagatttaaaaagtgagctaaaaccttaaattgtggataagtgttaataacttcgaaagttatccacaggtagtccacaggctaaaagttaaattatgacggctaatttgagttattaacagttccaacagcccttattactactactatctttttattattaattaatatataaaacagagagcaacataaaggagttttgtaaaatgaaatttaccatcgctcgaaatacatttatcaaaaaattaaatgcggttcaaagagccatttcttctaaaaccacgattccaattttgactggattaaaaattgaagcagaagaagatcgtttaattctaactggaagcaatactgacatttctatcgaaaccaccatttcaactaacgatgaagaagctcatcttaatatcgaaagtaccggagcggtagttttaacagcccgtttcttcggagatattgttaaaaaattaccagacaacactatgttacttgaggtaaaagacggttttcaaacgaccattacgtcaggtgcttctgaatttaagattaatggtttagatgctaataacttccctcatttaccagaagttgatagtcaaacaaccattactttaaaagctgatgtatttagcgaaatgattaatgaaacagttatcgcagtttctaatcaagaaagtcgtccaatcttaactgggattcattttacgattgaaggaaataaattatcagccgtagcaacggatagtcatcgtttgagccaacgggtaattaatctcccagaaccaattaaaatgcctgaagatattatcatccctgggaagagtcttttagaactttccagaatgttagatgatgaaattgatacaattacacttcaaatttcagaaaaccaagcattatttacatttgatgaaactttattctattcacgtctattggaaggtttgtatccagatacatctcgtttaattccaaaggaaagttcaactgaaatggaatttgaagctccagaattgttagcttcgattgaacgggcttcattgctttcacatgctggacgcaataacgtggttaaattaacgattaacgcggctaacaagcaagcaatcatctctggtgattctcctgaagtcggtaatgtagaagaagaagtggttactaaagatattgtgggtgaagaccttgaaatttcctttaacccagactatttgaaagatgcgctacgttcatttggacatacatcaattaagatggcctttacttcagcattacgtccatttactttggtaccaactgaagatcaagaaaactttattcaattaatcacacctgttcgaacattttaataaagtaacgctatggagtttgagaaaattaatttctcaaactctttttttggataaaactggttaaaaacgcgtatacgtaaatttgagaaaaaataacccgtttaaggcaaaaaacattcagaagggttaaattcgctgagaagccgttttaagacagataaaattgttttttagttaaaataaaggtataatattatgagatacgtggggtgatagtatgcaaaaagatgttgaaataaacacagagtttattactttaggacaactcttgaaagaagagggtattattggcactggtggacaagctaagtggtttttacgtgaaaataccgtcctggttaacggagaacacgatgatcgccgtggaaaaaaactttacgaagatgatgtagttgaagttccagatgaaggttctttcaagattacaatgaaatctggtaactaatgtatctgaagacactggagttacataattttcgtaattatgctgatcttgttgtcgagttcggttcgggaatcaatgttctattgggtgaaaatgcacaaggcaagactaatctattagaatctatttatttcttagctttgactagaagtcaccgaaccaatagtgatcgagatttgattagttggaaaaccaaagcagcgcgagtatcagggagtgtccaaaaagaacacaccgttacaccgcttgaaatcaatttatcttccaaagggaaaaatgccaaagtaaatcaccttgagcaaagccgtttatcgcaatatgtcggccagcttaatgtgattttgtttgcgcccgaggatttatcaattgtaaaaggatctccagcagttcgccgtaagttcattgatatggaatttggacagatgagttcgaaatatctatataactcggcgcaatatcgatccgtactgaaacagcgaaatcagtacattaaacagctacagttcaatcctaagggtgaccaagtttatttagatgttttaagtgatcagctagcagcccatggagctgaaatcattttccaacgcattcaattcttgaagaagttggaaaaatggtcccaagaggtgcataaggaaatctcgcagggaaaagaaaaattatcttttcaatatgtttcaccgatcagtagtgatcaagccgatactactgaaaaaatctatgcagcactacaagcccttttccaaaagcaacgtgaaaaggaacttcaacaaggtaaaactttagtggggccacatcttgacgatgtacgatttatggttaatgacaaaaacgtatcgacgtttggttcacaggggcaacaacgaaccacggccctgagtgttaaattagcagaaattgatttgatgaaagaagaaaccggagaatatccggttcttttacttgatgatgtgttatctgaacttgacgatagtcgtcaaacacacctgttaactgccattcaaaacaaagtacaaactttcatcacgaccaccagccttagtggtgttgcgcaacaattaattaatgaaccccatgtctttaatattgatcacggagttttaatgcagagcaaggaggaataagcttttggcagacgaaaaagaaacgaaagcagaattagccagagaatatgatgcgagtcaaattcaggttttagaggggctcgaagcagttcgtaaacgcccagggatgtatattgggtcgactagttctcaaggactacaccatttggtttgggaaattattgataatggtattgatgaagctcttgcaggatttgcagacaaaattgatgtgatcgttgaaaaagacaatagtattaccgtcactgataatggacgtgggattccggttgatattcaaaagaaaactggaaaaccagctttagaaacagtctttacggtcctacatgccggaggtaaattcggcggtggcggttataaagtttctggaggattgcatggtgtgggcgcatccgttgtaaatgcgttatcaacggaattagatgcgcgcgtcatgaaggacggtaaaatttattacattgattttgcgctaggaaaagtaaaaacaccgatgaaaacgattggtgatactgaacatcctgacgatcatggaactattgttcatttcgttccagatccagatattttccaagaaactaccacatatgacattaatatcttaaaaacacgaattcgtgaattagcctttttgaacaagggtctacggattactttgaaggatatgcgtcctgaaaagccaactgaagacgacttcttgtatgaaggtgggattcgccactacgttgaatatttaaacgaaggcaaagaagtaattttccctgaacctatctatgttgaaggggttacaaaaggtatcactgttgaagtagctatgcaatatatcgaaggttatcaaagtaaattgttaacttttactaacaatattcatacttacgaaggcggtacccacgaagaaggtttcaaacgtgctttaacacgagttattaacgattacgctaaaaacaacaatattttaaaagaaaatgatgataaattgtctggtgatgatgttcgagaaggtttgacggcagtagtcagcgttaagcatcctgatcctcaattcgaaggacaaacgaaaacaaaattgggtaactcagatgctcggacagctgttaacgaagtgtttgctgaaactttcaataaattcttattggaaaatcctaaggttgcacgtcaaattgttgataagggaatcttggcagcaaaagcaagagtcgccgctaaacgagctcgtgaagttacgcgtaagaagagtggcctagaactcaataatcttcctggtaaattagctgataatacttctaaggatccttcaattagtgaattattcattgtcgagggtgattctgccggtggtagtgctaagtccggacgttcgcgtctcacacaagctattttgccaattcgtgggaagattttgaacgttgaaaaagccactttggatcgggttttggccaatgaagaaattcgttcactctttacagcgctcggaactggatttggtgaggactttgatgtaagtaaagccaactatcataaattgattatcatgaccgatgccgatgtcgatggtgctcatattcggacactattattgacgctgttctatcgttacatgcgtccaatgattgatgcaggatttgtttacattgctcaaccaccgctctaccaagtacgtcaaggtaagatgatccaatatatcgattctgatgaagaattagaaacagtacttggacaattgtcaccatcaccaaaacctgtaattcaacggtataaaggtcttggtgaaatggatgctgagcaactttgggaaacaaccatgaatccagaaaatcgacgcttgttacgagtttcagccgaagatgctgatgctgcaagtggtgattttgaaatgttgatgggtgacaaggttgaaccacgtcgtaaattcattgaagagaacgctgtgtttgttaaaaacttggatatctaaaaagattattaaaagttagacagcccaaaaaataagggggaaaacgaattgtcagaagaattgtcaggacgaattacagatgtcaatttaagtagtcaaatgcgtacatcattcttggattatgccatgagtgttattgttgcgcgtgctttacctgacgttcgggatggactaaaacccgtccatcgtcgtattttatacgggatgaatgagttaggagttacacctgaaaagccatataagaagtcagccagaatcgttggggatgttatgggtaagtatcatcctcatggtgactctgcaatttatgaatcaatggtccggatggcccaagactttagttaccgttacatgcttgttgatggacatggtaactttggctctgtcgatggggatggcgctgctgctatgcgttataccgaagctcgaatgagtaaaattacattggaaatgctacgtgatatcaataaaaataccgtggatttccaagaaaactatgatggaacggaacgcgaaccatcaattttaccagcacgtttcccaaacttattagttaatggagcaactgggattgccgtggggatgacgacgaatattccaccacataatttgtcagaagtcatcagcgctatccatattttgatgaataacgaagatgcaacaaccgccgacttgatggaagctgtccctggaccagacttcccaaccggtggaattgtgatgggtaaatcgggaatccgtaaggcatatgagactggacacggtacgattattttacgggcgaaagttgatattgagactgaaaaaaatggtcgcgaacgcattgtggctacagaattaccatacatggtcaataaggctaaattgatcgaacgcattgctgaattagctcgtgataaacgaattgaaggaattactgatgtaaatgatgaatccgatcgtgatggacttcgagttgtcattgatgttcgtcgtgatgtcagtgcatctgtagttttgaataatctttacaagatgacattaatgcaaacgacctttggatttaacatgttggccatcgttaatggcgctcctaaagtgttaggcctaaaggaaattttgcaacactatcttgttcatcaagaagaagttattcgtcgacggactgaatttgatttgaagaaggctgaagcaagggcgcacatcttagaaggtttgcggattgctttggaccacatcgatgaaattattgcgattattcgtaattcacaaacggctgaggttgctaaagataaattgatgaataactattcattatcaagtaagcaagctcaagcaatcttggatatgcgtttggtgcgtttgacaggactagaacgtgaaaaggttgaagacgagtacaacaaggtcatggcagcaattacggattaccgtgatattttagctcaccgtgaacgaattaacgaaatcatttataaagagttacttgaaattcaagagcgctttggggatgaacgtcggacagaattgatggtcggtgaagttcttagccttgaagatgaagacttaatcgaagaagaagatgtcatggttactttaacccataatggctacattaagcgaatggctacgtctgaatttaagacgcaaaatcgcggtggtcgaggaatccaagggatgggtgttcatgatgacgactttatcgaacatctggtttcaacttcaacccatgatgtacttttattcttcactaatgccggtaaggtttaccggatgaaaggctacgaaatccctgaatatagccgaactgctaagggaattccagtaattaacttgcttggaattagtagcggagaaaatattcaggctgtaatcaatattggacgtgataacggtgatgaagataatgaaaatcgttacctcttctttacaacgttaaacggtgtgacaaaacgaacaccggttgctgaattcctaaatatccgtagcaatgggcttaaggccattagcttgaaggaaaatgatgaagtaattaacgtggttattaccgatggcgagcaaaacattattatcggaacgcataacggatacgcagtaagctttaaagaagcagatgtgcgttcaatgggacgttctgctactggggttcgcggaattcgtttacgagatgaagattatgtcgtcggttcagcaatcttgaaacctgaaagcaaggtcttggttattactgaaaagggttatggaaaacaaactccggctagtgaatacccaattaaaggccgcggcggtaaagggattaagactgcgaatatcaccgaaaagaatggtccattagctggattagtaacggtggaaggaacggaagatgttatgttgattacggatcgcggggttatgattcgtttcgacgttaataatgtttcaactacaggtcgggcgaccttaggggttcacgtaatcaagacggatgaaaattctaaagttgctacaatggcaattgttgatgaagcaccagttgatgatgaaaaccagactcaaactccagcaactgaagcagcagaaactgaaagtgtaactgttgaagaaagttctgaagaataaatttaattaaaaagctgattgaagtgatttttcactttttaatcagcttttttaattaataaaatgaattagaaaattttggtgtatttatcatttgtatatcgttaattaggattttttgttattgcgtccactaaaaatggatggtataatacttatttgtgagttgccagcttttttggcaaactctccttgctttctacgttgtgatagaaggccataagtccatgaggaggtgtaaatcaatgaaaaactacgaaatcacatacatcatcgctccaaatcttgacgatgcagctaagacagctttagttgaccgttttgacaagattttgacagacaatggtgctgaaattgttgattcaaaagactggtcaaaacgccgtctagcatacgaaatcggtggttttaacgacggtatttatcatatcgttaacgttaaggctagcgacgacgaagctttgaacgaatttgatcgtctatctaagattgctgacggaattcttcgtcacatgatcgttgtacgttaataataacaactaaaaactaggaaggagcggatattatgattaaccgaacagtgcttgtcggacgcctaacaagggaccctgaactacgatatacaggtagtggagctgcagtagtaacttttacagttgctgttaatcgtcagtttactaattcacaaggtgaacgcgaagctgactttattaattgtgttatgtggcgtaaagctgcagaaaactttgctaacttcactcggaagggttcattagttggtatcgacggacggattcaaacccgttcttatgaaaaccaacaaggccaacgagtttatgttaccgaggttgtagccgaaaacttctctcttcttgaatcacgttcatcttctgaacgtcgtcagggtggagaaaataattttggcaataatcaatctgccccttcacaacaaccaacatcatccggaaatccatttgacgggggacaatcgaataatagtggtgcacaacaacctaacaattcgaaccctaatgacccatttgctaatggcggtcagtcaattgatatttctgacgatgatttaccattctaaaataatagaggagggcaatcattatggcatttcaaaaacgtggtggccgtcgtcgtcgtaaagtcgactacattgctgcaaaccatattgaatacatcgattacaaagacacagaattgttaaaacgattcatttcagaacgtggtaagatcttacctcgtcgtgtcagtggtacaagtgctaagaaccaacgtcgtttgactattgcaatcaagcgtgcacggatcatgggcttgcttccattcgttgctgaagactaatctttagctatataaagtaccattcaggccgaggcttgaatggtactttttgtttaaataaaattagggcggtgatggatcataattggtcaattatggctctatttttattagaataaccttccaacaaacgattttaattattggttataagtatggtaaaatcagagatagttagacacaattttttaggagaagtgctatgaaattagtagatcatctacctgcatttatccgtaacccgcgggtcgggattttaacagcagttattattttgctgtcgttgattgggctgggattagctttttatattaacttattaatcggcatcatcatgctagtattggttattgttactggcatttttagtgttcgcacgttgcgtttactgagtgatgagactgataaatatatttctgaattgtcgtttcgaattgatcaggctgaagaagacgctacgttgtctatgccaattggaattttaatttatagtgaacagcatcgagtggaatgggttaaccctaatttccaaagttattttgaaggacaaaaacttttgggacatccattggatgaaatcgatgaagatttggcgaagattattgaagaacatcaagatgacgagaaagttagccgtgtgaaatggaacgatcacgtttttgatatttcaattcaaaaggatgatcgcgtagtttacttcctagattcgactaaatacgcgaaaatggaagagcaattcgatgaccgtcaagtggtaattggtcaaatctttattgataactatgatgaaattacacagtcgatggctgattcggaagtttctaatttaaacaactttgttaccaaccagatttctagttgggcgcaatcgtttgggatgtatttaaggcgcgttgatgatgatcatttctttgtcatcatgtacaacgaaacgttagctaaggtggaagaggatagttttaagctcttggatactatccgagaagcaacttctaaacaaaactctccagttacattaagtatcgggattgcttacggggatgataatcttaataagcttgccgatgtttcgcaaagtaatctggatttagcgctaggacgtggtggtgaccaagttgtcgtcaaagctgaagatgaacaagctcgtttctacggcggtaaaactaatccgatggaaaaacggactcgcgttcgagcgcggatgattggacaagccgttcaagaattaatgaaccaagcagatcaagtctttgtaatggggcactcccatgcggacttagattcagtgggttcagcgctcgggattcggcgaattgcgcaaatgaataaaaaagagtgttggattgtcttagaccaagaaggcgtgcattcggatgtagcgcgtttgattgaaaaaatggatgagcatgaagaccttaaagagtccattattagtgcagatcaagccgtagagctcgctaatagccaaagtttgttagtgatggttgatcattctaaacgttccataacgacatctgaggagctatttgataagcttagtaatcgggtgattatcattgatcatcatcgccgtggaacggagtttccagaaaatcccgtgttggtttacattgaaccatatgcatcatcgacgggtgagttgattacggaaatgtttgaatatcagtcccatgatggtgaaccaattcaaccgattgaagccactgctattttggcagggattgaagtggatactaaatcgttcacggaacgtacggggacaagaacttttgatgcagccagttatcttcgttcagtgggagctaacgagaagacgattcgttacctcttaaaagagaatgttgatagctatatgcaacgaaaccatttaattgatacaatgcagtttattgaagataaatatgcaatttgtaccggtgaagatgatcgaatgtatgatccagtgattgcggctcaggcagccgattcactactgaatatttcaggcgtagaagcctcatttgtgatcacacgtcgtggagaccatgctgtgggtatttcggcgcgaagcgcaggaacggaaaacgtccaggttatcatggaaaaacttggtggaggcggtcatttagcaatggcagcaactcagatagaagatgtgagtgttgaggaagccgagcaacaattggttgaaattttacaagaaaatcaaaaagatgaggagtgattctgatgaaagtaatttttttggaagatgtcaaaggtaaggggaaacgtggcgaagttaagaacgtttccgatggttacgctcaaaatttcttaattaaaaatggtaaagctaaagctgctacaagcgctgcggtaagcgaattaaagggtcaaaaaaaggccgaagctaagcatgaagctgaaattttggctgatgctgaaaagcttaaaatggttttagaagatgataagaccgtggttgaaatcaaagccaaggctggaaaagatggccgtctatttggttcaattccgaacaaacaaatcgctacggcccttgaaaaacaatataagattaaaattgataaacgcaaaattgagttgagcaaccccatccgtagcatgggctacacaaacgttcccgttaagttacaccaaaaggtaacagcaacgattcgggtgcatgtagctgagcaataggattactaaggctctcaactcagagtctaattcgtacgggagagtaacatggacaacggtattttagaaaatcaaacgcctccgcaaaacattgaggccgaaaaggcggttttgggagctgttttcttaagttcagatgcattgattgacgcgatggaatacgtcacggcggaagatttttataaacacgctcatcaagttatttttaaagtgatggttgatttgaacgatgcggatgaagccattgacgcattgacagtcaacaatgcacttgaagaacataatcaaatcgaagatgccggtggaattacttacattgctgaattggcaggatcagttccaaccgcagccaatgtcggctactacgctaagattgttcaagaaaaatctttattacgaaaattaattaagacagcaacagcgattgctacaaaaggttacacccaagatgacgatgtggctaatatcttggacgaagctgaacgtgaaatcatggatgttgctgaaaaccgtaatcaaacgggttttaagccaattgcagatgttttaacaacttcaatggaagaaattgatcgtctttatcaaaatgacgatgagattaccggattaccaaccggatttaaagagttagataaaattactactggattacatgcagatgaattaattattcttgcagcgcgtccagctgtcggtaagactgcgtttgcgttaaatattgcgcaaaatgtgggtactaagactgataaatcagtggctattttcagtttagaaatgggagctgaacagctggtaaatcgtatgttatgtgcggaaggaagtattgatgcaaatcatttaagaaccggtcagctaaatgaagaagaatggcaaaatttagtggtggcgatgggttctttagctaaggcaagtatctatatcgatgatactccgggaattaaaatgtcggagattcgtgcgaaatgtcgtcgtctagctaaagagcaaggaaaccttggcttagttgtggtagattacttgcagctaattgaaggatctggagaaaatcgtcagcaagaagtttcagctatttcacgacaacttaaaaaactcgccaaggaactaggcgtaccggtcattgcgctttcacagctttcacgtggagtggaacaacgccaagataagcgcccggtaatgtctgatatccgtgaatctggttcaattgaacaggatgcggatattgtagcattcctataccgtgatgattattacgaacgggaagatggcaatgaagacgcagatcgagaccaagatccacgggatgaagaagatcaaaatgttggtcccgttgaagttatcattgaaaaaaaccgtagtggggctcgtggtacggtaaatctgttgtttattaagtcgtacaataaattttcttcgttagcttatatgcctgaagcgggagcgcattaggtatttgaaaaatgagattcattattttcaagactggtttaagactttttagtctaaatcagtcttttattataaaaattaggggaggaattatgcgcgaattaaaattaaagtggttattattaggagttttgattgatagtattgcgatgagttcagtgtggccactaacaacaatttatatgaaccaagaactaggccattcattagtaatggcagggattgttttatttttaaactcagttgctagtattttaggatcttttgttgccgggcgcctttatgacaagtatgatagctattatttaatcttaggtggaattgcatttacctggatttcgttctttacgttgattttcttcaacggctggccagtatatccgattgtattggtactaatcggatttggaacaggttggattgttgccttaaataactcaatgggaacatcaattaagagtaaagatggccgatatgtttttaacatgctatatttcgtccaaaatttaggggtcatgctaggtactgctattgtgggagttttatttaagcacagtgtcacgccgcttttcaccatagcaaccattatgtttacggtatttttcattgtagcgttctttacttaccgaattccacaagaagatcgccctgctcaagtagtacaagaagacgatcatgagaaaactaaaatgccaaaagttaacttgacaattatcatggcatttttcattagtttggtaattatgtgggttttctatcaacaatggaatagtacggtttcgatctatatgctaaaattgcacattccgcttcgtttatacagctttttatggacggtcaatggattattcattttaatcgttcaagggcttctcagctccaaagggggacgtttactgaaggatccatatcatcaagtctatttggggattgcattttttaccctatcttttggaattctagccgtagcacacgaatattaccactttgtaatcgccatgattgttttaaccattggagaagcaattgcctttccatcgattccagcaatcgttaacagtctttcaccttatgaccaaaagggaaaatatcaaggtctagcaagtgcttttccttcggctggccgggcaatcggtcccttagttggtagtatgataattgaatcaacctcatttgttttcctttatagtttaggactatttacaattttaattgttttagtagttattgcgttcattattgaaggcactaaacggaaagcaattttatacgaatctaataaaaaaggatagcctctaaggctatccttttttatttagaaaataaataataccaaaatcaaagtaatcaaggcgggtaaaccttggactaaaagaatctttttggcgacggtgagagcaccgtatgctgctaagataaaaatgcttgctaggaaaaagatgagcatcatcttcataatagtccctgttggaataaagagtgccaagaagagggctaaggccacgaagccgttataaagaccttgattggctaacgccgttcgtaaatgagggcgttgaacttccactaagggaatttcaaaggttttggcaagaaatgcactagaacccaataattcaatgcccatgatgccaatatgctcaatggctacgagtgcaactaagataactgttaatatatgcaaaatattcaactccttgtgtccaccattataacgcatccgcatcttttttgattaaattgaagttcagcaatggagcttgaagcaaaaaatgaacttcaattttaaggtagaatggtcaaagaacaccaattgggtaatggaaatcttaattttatcgacgtctaaaaattagtttacaccgttgtcgattttgctttttccatatacaattaagtcttgtaatgactgaaatgaggaattgaaatgattattttaggggtattactaatagcatgggttggagcactaacgcgtacagttttcggatttggggaagctctagtttcgatgccattattggcattaattgggtttgatctacagaccagcaccgcattaatcggagcggtgggcttactggttgctttaccagccacgattcgtgagtggcatcatattgattttaaagcggttcgtcgattaatgacaggttcactaattggagtacctctaggaattttagtcatcaagaaagttcctgccgcaattgtgttacatggcttaggaatttttttaattgcttacgggatttatagcttgtggcatagtctttcaggtcgagtcgggcgcccccatttacaagcacaaggctatgattatttgaccggaattatttcaggcgcactaggtagtgcatacaacagccatggtgtgccagtggccgtatatggaactttgaaaaaatggccagcccaacagctgcgggccattctccaagctcattttttatgtgtgggaatcttggtcgttgcaagccatctagcagcgggtttttggtcgatagatgcgttggaagtattagctatggttattccaggattgctagtagtggtaccttttggtaattggttagtagcgcgaattgctcccgaaagagccattaaacttgtgtatggggcgctaatcatttttggaatattattaatgactaaataaataagcgttacactaacttgggtcttattttaatatcagattacaaagagggatatttcttgaaaaaaaacgcattcattgttaagctaaggctagtttattaggaagggatgtcgatgggattgaagattacagactaattttggaaatattggaatgacgatttctttattttcgggagtagtttgtagtttttgatacattcgatgtgccgaccaaaaataaatttttattggtattatgcactttgtattgcatcaggcctgcacacctggtgcttttttatgccttaaaacgaactactcctcgaaagagaggagacataaatgggaataatacaattaaaaaacgtaagctttagctacgataaccaaataaaaccggtttttgaccaagtagcgttggaaatcgatgctagctggaaattaggtctgattggcagaaatgggcgtggtaaaacgacgctgatgaagattttgcagaatcaggttgaatatgagggaaaagtggaaaccaacctgaagttcaattattttccagctaagattactgaaccacaggattcggtgcgaatggtcctgatgaaaattactggtcgcgattactctgatttctgggaggttgagcgagaactagaccaaattggtcttgctgaagaaattttagagcagacttatgcatcactaagtccggggcaacaaactaaagcccttttagcagccatgtttgcagatcaaaattcatttcaattgattgacgaaccgacgaatcatttggatgcagctgggcgcgaccttttagctaaatatttaaaacaaaaacaaggatacattgtggttagtcatgatcgttactttttaaatcaagttattgatcatgttatttcaattgatcgtgctcaaattagcagctttaaggggaattatgaaacctgggcagctgaacgtgccaatgcggatgaacgtgaaatcagtttgaatgccacgatgaaaaaagatataaaaaaattagaacaggccacgcgccaaaagcaagagtggtcccgagcaacggaacgtaaaaaagctggtgctccggataaggggtttgtaggtcataaagcggctaaagtgatgagcaaagccttgaatattcgggatcgggctgagaaaaaattaacagataagaaacaattactaaagaatattgaaattcaggatgaacttcaattgaattatcaaccgtatctcggaccccaaaacaatgctttactagaagcggatagtttagttttacaaagagctggaaaactattaaatcagccgcttaatcttgaactaaagaagaatgagcggatggttattcaaggcgaaaatggttctggaaaatcaaccttaattaaggcaatgttagggcaaaacgaactaattgctaaaggtaatctaaaaatacgcgaaaatttacgaatatcatatttaccacaggattttgaccagctccaaggcacactagaacagtttgctgccgaaaaggaagttgaagttcaggacttgctggcaatgctgagaaaactgggttttgaacgtacgatgtttgattatcgaattgagcagatgagtatgggacagaagagaaaagttgccttagctcggtcgctgtgtgaagaagccaatctatatatttgggatgaacccctaaattacctagatgtaatcacacgggagcaaattcaaaatttagttttgaagttcaagcccaccttattagtggtggaacatgatcgagagtttgtccagaaaattgccacgcagactgttaacttaaaaaaataagcaaataattttgacacggtgtcactttgtgctattctagcattgttgacatggtgtcatttttattttaaggaggtggaggagtggcttcagatgttttacagaagttgaaaccggataaaagaacggccatcgaagaatcgctattattggaattcacgcatcatccggttacagaagcacaagttgctcgcatcgtgaaaggtgccggaatttcacgtggtgcattttataattattttaaagatgtaccagatgcttaccgttatttatatcaaatcgcaattcaggatatccaccaggcaattcggcaaaatgaaaggcgtggcgaaaatttggtcgatgaagctcgccaatttattaagaatactcagaataataagtattacgagctatttcaaatgcactatcactacaacgaagtttatgtgaccagattagttgcaccacttgaaccgcatgctgagatacagtgggcggaaatgacactaatccacgatacaattcgttgcgcactgattgaaccagggactaccgatgcccgattacaccaattagaaaaagtcctaaaaattctggaggaataattatgtttctagctttaaaagaaatcaaaaaagaaaaattacgatacagtctaattatcggaatgattgttttgattagttatttaatttttattttaactagtttagcactaggtttagctcatcaaaatacggatgccattaactcctggaaagtagaaacagtagttttaaaccaagatgccaacgttaatttaagtcagtcgttggtgactgatcaacaagtaaaagaccaaaaattaactaaaaaagatgccttgattggacaagttgcggtagtagctaaagaccaaaaggggaagcaggctaagatttcttctagttttgttggaattgataatgatcaattcattgctaaagacttgaaacttactagtgggcataaagtgaagcaagaccacgaagtagtggtagatgaaaaattcgaacaaagtggttaccgacttggcgataaaatcgaattgaatgatgcagataaagcatttaaaattgtcggttttactaagaatgcgaagttaaatattgcaccagtaatttatgggaaattatccgattggcaagcgctcaagcatgctacaccacagactaaggctagtgcaattgtttctaaaactaagaatttaaaggttaaggaaccgctaaaatcttacaaagttaaatcctttattgagaagcttccaggttactcagctcagaatatgaccttctcactgatgataggatttttaatggtcatttctttaatcgtcattgccatcttcctatacatccttactatccaaaaacttccaaattatgccgttttacgagctcaaggaatcccaagtagcgtgttagtttggagcacgttagctcaatcactaattttggtgattagtggaaccattattggaacggctctaacagctgctacagctgctattttacctgctgcagttccaatggcatttgatattccaatccttgcatcagtagccgtaggattggtaatcacagggctgttagggggcttgttaccaatacgaagtgtactaaaactagacccagtaagtgtaattggaggataaatgatgactgcaattgaaatgaataatatcaaccaaatttatggaaaagggattgctaaagttcacgtattacatgacgttaattttagggctgaagctgggacattgagcttgattattggtcccagtggttctgggaaaagtacattcttaaccattgggggcgggttgcggactccaactactggacaagttaaagtgaatggacaagattatcaaactagttcccgtaaagaccttgaaaaattaagacttaataacattggtttcgttctacaaaattaccatttattaccatttctaacggttaaagatcaattcaaattggtcgataaagtaaaaaaagaaggtaatttatccaaagaaagtttagataaattattgcaacaactaggaatcgaagatttagttgataaatttccaacagagttatcaggtggtcagcagcaacgagtggcgattgctcgggccttgtatcccgatcctgccattatcttagctgatgagccaacggcggctttggatagtgaacgggttaaagaagttggtcgtttatttgcggatctagcacacgatcgtcataaagcggtagtaattgttacccatgatatgcgcttgaaatcgtatgctgatcaaatgttcgaaattaacgatggtgttttaaaagaatcaacgttataagtaataaaaatgatgatagaaattttttctatcattatttttttacccaaatttaacttcaaaaggaataaaatgaagttaataaaacttgatttttaagccatgtaacaggtttgttgcttggtttttaaaatgactgtggcagagtagaactagaaggggtggttggatgtcaatcggaacaacgttacaaaaaatacggcaagcacgagatcttactcaacaagaagtggcgacacaaatgtatgttaccagacaaacgatttcacgttgggaacaaggaaaaacgatgccaaatatatatgctttaaaagatcttgcgcagttgtataatgtttcgctcgaccaattggttgcaatgcatccctctaattcgaaagaggaagcaggtcataaaatgaaaaaaattaattggttagcattatttggttttttctggttcaacgttattgtcaccatgggagttgtcttggcagttgctggaattttatgtggtctttggatctccatcatcggctttatagtgtctccagccttattagtaggtgaatggctggttgtccatatgatgggatgggtaactcctgttagtttaaacttgtatcaaatcccgctgacattgatgctttgtgcaatcggattaggcgcttttccattgctaaagcagctgacgatgtatttagtaaacttttttgaaagatatattagatataatctccgttctatttatactgaaaaatgataaaaaggcaaatcaactgacgttggtttgcctttttaaagtttgatttaaaagtaatcccatagcataggtggttctttacgtaaggtagcatctaaatttgtgatagcctcatagctaccgcgaatcgctccaattcgattaagttcatttaaggaacgataacctaataaaactttagtgagttcttgaatagatatacgaatgtcagccatattattttcgttatcactaattttctcaaagctagtgccattggcattgattaaaagacgccaaattccgttattagccggaagcattttatcagtaactgcaacacgagtgcttttgattttctttaagaatggatagtgattaatgaaggtctcaaggttaataatgcgagccatcatgtaaggcttaatctgaacttcaacattggatggattctttagaatgtcaggatggcctaaagggtcaccactggcgtattcgaaagttgaaaacatcgactcatgttggcagataaagcgacttagatattggaaactttcccaattagtaaacatgatttcttgaatcgagaaggtagtatcaagcccttcgtagataacgtaccccgcagataagtggtcttcagagaagtagacgcccacttgccaatgaggatgcttgagaacgagataatcccaccaccaatcctcacgaattaaaccagcattgtggctgttgggattattagcataaacttccttaataaatggaatagcttcggctaaggttaaacgttcaatactaccaatctttttgtcaatctttactctcgataagtcggtgtttttaacccgatagatggtacgatcaaaaacttcttcatacccaaaacgacgatagaaatcgtatgaaaatggagcaagatatgagagagcaacgttgtcttctaacatatcgttaaaagcctgttgcatgagttgggtaattgctccgttaccgccgtattcggggtaactcatgacatcgccaatcccattcatcttgtatttcacaccatgaaagttaacgtgaaatggaatacttaacatcccgcttccgagttttccattatgtttgattccatattttaaagcatggttgtagcgatgatcaaagaaagctcgtcgtccttttgaatctaagttcgtaaaggcgtacaggtatagttgataaaattcttccaaatctttttgggttaactgttctaatttatccatgtcgttgggcctcattaatttttattaactgcttttcgttttagaagtgctcctagtactacaaatactattataccagcgatttcaactactcgattagttagggttgaagttaaatgaagttgggtcatcgtaatagcaagagctgcaatcaagatggcacctactacactatattttaatagaattttgattttcatgaaagattaagcctcacttgcttcttgggcaaccatttgtttttcagccactttgaagaagggatagtagattgctccggcaatgactagttcaattgctgaccaaactcctgcacgccaatcccaaccagttgccattaaaggtccgataattggcggcatggtccaaggaaccatcattacggctgggcgaactaaatggacgctcatcaaaatgtaggttaggaccgttaaaatttgaggaatcacaataaaaggaatcaaggtgattggattcataactattgggaaaccaaaaattacgggttcattaatttcaaataaggcgccggggaaggcaactttaccaagttctcgataagccttactcttggatgaaagcatccaaaatacgagcataatggtcgcaccggttccaccaacattaacaaataaactagaaaaaccagatgatgttaagtatggtatagtttgatggtgtgcgtaagctataccattagctgttagaaattgaaggaagattggatccgagatcccttcgagtgtcatatccccatggatacctgctacccacaaaacactaactaataacgtgtagaacataattcctggtagactgttcatagcaaataataggggatggaagatgctttgaacaaatagattaatatcaaaatgaaggggaactcgaagcccccagaataatagcaaaactaaaaaaccaggaattagtgaaacaaatgattggctaacagcagctggaacaccatttggcagtttaataacccaattttttttaacgaataagttcaaaatcaaaacagaaataaatgaacaaacaatcgctgtaaacaagccagatgaagcgaagtttgcagtatcgagggtgtatttactgttgaatgaagctacgataaaagccatcgtggaaagcccagcgccattgatagcgtctaactccaaagctttagctaattcgtaaccaattccgatggcagctaacagtgaaatgattccgaaagaaccattaactgcaactcccatggcgtccatgtatggtttcataaaattcgaccaggcagggattggaatattagcaataattaagaaaattgaaccactaatcacagccggtagggttaatactagtccgttacgaatggaaaccagatatttattattccccgctttagcaagtggtggcattaggacattttgtaaccagtccataaatttattcatgaaaaatctcctcctttatattttggtaacaaaaacagtatagtgataaaaatcattaatgtaaacccttgcaaatgatatataactaaaaaatgacataaaaatgttaaatatgatgatattttaattatttttactaaaaaatataatggaatataccaattaatgttacgagataattttttatttaataaattatcagtgaaataaaaaaagcgctaattatcagagcagtaccgataatttagcgccctttattaatcgactttcacgagtgctacgtcttcacctttagcttgtaaagtgctaacgtgcatttcgccccaactacataatgtgtcgagcaatttttcaagcgatcttccataatcgcttaggtaatattccactttaggtggaacggtgttgtatgatttacgaactacaatgttatcctgttccaactcccgaagttgttgggttaacattttttgactaattccttggatattacgccgtaattcactaggacgttgttgtccatggcggaggttacataggatgatgggcttccatttaccgccgataacatccattgtcgcttccacaccaatattataaattcgttttgtcataaagtttcgctccttttttgccagtataacacaaagcatactttttggtatgtatagcacaataaagtgggtactagctgaatagaaacagtttagttatagttaaaattataattgaacttcaaaggagaaaaaaatgattaattctttaaacgatcgcataatgttaaataatggaactgcaatcccagggctaggtctgggagtttttcaaattccagatgcagatacggctcaagtagttgcaaatggaatcaaaaatggttaccgtttaatcgacacagcacagatttacggaaatgaagcgggaactggagcaggcattaaagccgggttggcggcaactggtttgaagcgagccgatttatttgtcacttctaaggtttggaatgaccacttatcgtacgatgaaacgatagcagcctttgagagtagtctaaagaagttaggtttagattatttggatctttatctaattcattggccaggagataatgcatttcaagatgcatggcgagcactagaaactttatataaacaaggaaagattaaagcgattggtgtaagtaatttccaaattcaccatctccaagctctagcggaatttgctgaaattacaccggtaattaatcaaatagaaactcatccgcaattaagtcagctcgagatgcgagaatatgcagctaaacatgatattaaagtccaagcttggtcacctttgatgcaaggaaaaatcttagacaacgctgtgttagctaagattgcccaaaagtacaataagtctgtcgctcagattgttttacggtgggatgttcaacaaaatattttgttagtagttaaatcagttcgtgccgaacggatgctaagtaacgcgcagatttttgatttcgaattagcaccggaagatatggaccaaattaatgctttgaatgaaaacttgcgcgtcggacctaacccagatgaatttgatttttagattttagaaggaggtacactatggatttacatttaacacataaattagctttgattaccggctcaaccaaagggattggaaaagctattgctacagaattagcccgtgagggggctgacgtgattattaacggacggaatcaagttgaggttgatcaagtcgtggctgatattaaaacccaatttccgagcactaacccgcaaggtgcagctgctgatattgccaatgaagctagtcgaacacacctgtttgagcagtatcccaaggttgatatcttaatcaataacatgggaatctttcaaccgatggaatatgccgatattgatgatgatacatggaataagttcttccagattaacgtattagctgggaatgctttagctaaattttacttgcctaaaatgttagatcaggattttggaagaatcatttttattgctagcgaagaagccgtgatgccatcgggagaaatgcctcaatacagcatgactaagaccatgaatttgtcgttagctaagagcttatcgaaactaacggttgctacacatgtgacggttaataccataatgccgggttctacattaactgaaggggtacagcaaatgctagaagatatgtacgctgatagtgatttacctaaatcagaatgggaagcggactttatgaaaaaccatcgttcccgttctcaaattcaacgtttgattcgtccagaagaaattggtcgtttcgcagcctttgttgctagtccagatgcatcgtcattttctggtgaagcattgcgggttgatggcggactagtgccaactattttttaaaacgcccacgcatatcattatcaattaaccactaatttctctatactgtagttaaggtattgttaatgctttaaatacgacaaggaggaattttatggcaaaagaaatcggcattatcgttggtagtttgcgtgaaggttcattaaatcgacttgtggcaaaaacatttgaaagtatcttacctaaagaatatgaggcaacgtggattgagattggtgatttgccattgtataacgaagatttagatcagggtgaaatcccagcagaatggcaaagactacgtgatactgtgcaaaatgtagcaggggtaatgttctttactcctgaatataatcgttcggtaccagcggctttaaagaacgcaattgatgttggttctagacccatgggcgaaaacgtttggggtggcaagccagctttggttgtatcggcttcccctggagcaattggtgggtttggggcaaaccatcaccttcgccagtccttggtatttgttgatatgccaacccttcaacaaccggaagcttatattggtaatgttccgcaacatctggatggtgaccattttgatcaatcgactacgcaattctttagtaccattcttgattcatatttagattttttagagcgctttactaactaacttaaactaaattatgcaaataaaaatagcctaaccagacggaaattccgtgggttaggctatttttcattgtgctttttcccctttagcacgtgatcagcatgttcaagagtttcattaacaatatctaagatatgcggatcatcgagttcataaaaaatcgatttaccatcacgtttagttgaaactaactggtatttacgcaaatctgatagatgatgagagaccaacgactgatcgagatggagaagttctacaatttcagaaacactgaggttctgctgcgacagaatgtataaaatttgaagtcgcaccgggtttttaagcaagctaagaattttttgggtctcagtgagcatcacatcgtcaattaattttagttttttttgcttcatattaacttcctttcatatgaatatgttatcatatgtatgtaaaataaggttggggaggaaaagcgatgataaaagatattttaacaggtgtaactgcatatatatcaactagtatagactatttaatcgttttgatggtcgtatttgcgatggttcctaaaaataagcgtattttagtttactttggtgatattgttggtacaaccgttttagtttcagcaagtttaatgattgcattggttttaaagtccgtccccgacgaatggatactaggattgctgggattaataccaattgctatgggtatcaagttgatagttgcgggcgctgctgatgatgaagatgtgattcaaaagcaaatcaacaatcggcgcggcgtaatcttgaatgttgcttttattacgattgcgacttgtggagcggataatatcggaatatatgtcccaatatttacgcagttgagcgtggctagtttaatagttgttttactaacgtttgtagctatgatgaccttgtttgcgctattaggatatctattagtttgcctcccaacagtggcaaagatttttgatcgatggggaactttagtaactattattgtttacattggattgggaatctatatcctctttgagagtggaacaattcaacattttattaatctgatataaagttaagcacagtctatgaactatgctttttttaacactttaacgtaaaaatcattgagtattaggaagtaaaagcttactataaaaggtataaatagtaattaaaaagtcttttggaggagtttttatgaataaaaaaagaatcactggtgcagctttagcaagtgcgcttttatttgcgcccttagctatccaaacttctacagcaatggccgatagtttttatacacaacaaaccaatgctgaacgtgccgatatcactaactgggtagctaacacaactgaagacattagtaataatattagtgctcaacatattgatactagtaatttacacggaaacgaatacataattcaatggggagatacactttctggtatttcagatgctacaggtatccccatggctaaattagcttatgataacaatattcaaaatattgacttaatctatgctggcgataccttagttctaaaccgcgatggtgaagtaccatcagattggcattactatggtgatggtgtttatgttgctaagactaaggtaactatcaataatttcgttgataatagtcataacacggtaaacattaatgtttcaccagtaagtcatgaagaagcaagttcgtctagcaaatcaaaagatgatggcaatgaatatgcatctgatttagatccagatggtaagaaaggtgaagcagatagcgataaggatgcttctaagtcaagttcagatgcagatcatgatgctgacactgatagctcatcagattctaaatcaggttctaagaatcatcattcagactcatcagattctaaatcagacagcgattcagatagtgaaatggatgaaagtgacttctcagatgcagttagcgatgaagtatcaagcaagttaggtttggatgatgacaagctaactgtagacttcactggtaaagatgatgacgactccgattcagatgctgatagtgatgatacaagtgatgactctgattctgatacagaggacgtttacgacagtgatcaagatgtttcaactggtagtgacaagcttacagatgaaaacgctgaaaaattggctgacaagattgttgcacaacttaaggctgatggtaagactaaagatattgatgacgctgacgatgttgaattaacaattgaagctaacgatgatgactttagtttcaacgtaactttgacaactactgatgatgattctgattcagatgaagacagtaatagtgatgatagcgatgctgatacagatgatgaagatacagattcagaagacgtagactcaagttctgatgaaggctccgatgaagatactgactttgatgacgaatcagaagacgctgatacagatactgaagatgaagatcaaaactcaagttctgatgacgaagatagtaataaccaagtcacaactactgatgacgaaaatacagatactgaagaataattaaccgagaggaactttggctgatgaagaagaaatggacagttattgggatcatcgttgctgtgatcgtaatcgtatgtggcggtgtgtactggaatatgggacactccgtagctaaaaaaataccgggtaacacttatctttaccagagtgtttcaaaagataagactttatatgttacctttgctaagagtggtgatcgggccgtagttaattccgataaggctactgccctcaaggcaggtaagagtcaacaagattttgacaaagaatataaggctcaatctaagttaacttcttggaattataaagctgaaggtggaactttaactctggctcaagaaactaaagatggtaaaatttcacaatggcaatataacggaattttagcgacaagtaagaaatttactgcccacagttttacttatcaaattgctaaagctggccaaggtcaagtgaagagtaagacggtatttgaaaagattaattaacttaatttaagttaaatgaaactgtgctaaaaggtgataaaagtctccaaagaggatttcacctgatggtgcagtttttggttactctaagcctaaagtagtagattaattaggacatagcttgctggaaaattaaaaagttgctatgattaggttaaattaaaacggaaatcaccaccgggtggtcaggcatttgtaaagctcattaggtcaatgaagagctttacggatgccttttttattttttaggaggaattgaagatgacatggttttatttagttttggcaggtatttttgaagtcgtatgggcaactactatgaagctcagcgaaggatttagtgttctaacatatggaatcgcgaccgcagtggggatgattatgagctttgtatttttatcattggcgattaaacagatgcctcttagtttagcttatccgatttggacgggaattggtgcagtaggttcaatcattgtcggcgtaatcttatttcatgatcaaattcctaatattacgtgggtttttattataatgttgattgttgggattataggaattaagatgactgcaggacattaaaacggcggaggatgtaggagtgcaaaaacctaaaatagttattgataatttaccagaggagtcattttttgagatttacaaggatgaagaccggatgctgataaatcatcaaattagaaatcaaaatgctgaaaagcaattccttgaacggggcatcatcgaacaatcttactttgaacacgttaagtttaatcaaagcgatttttatcggctagagttaaccgactcgatttttgttggctgtgatttttcaaactgtaaaatggaagaagcagttttttatcgatgtgaatttagaaattgcaagatgttagggatcaacttgaatggcgcaatttttaacaacgttctgttagatgggacgaatatgcagttagcagctctaaatcaaatgaaagttaaagatacaatgttcaatgcctgcaatctaaaagatagtagttttgctgaaaataaactacaaggagcagttcaatttgagcattgtgaaattgatcaaatgtccttttatgatacatcgctgaagcatgttaatctcagtacatgtttttttgaaaaaattgatgtagaagagcgtttaattagaggaatgcaagtcaatgctactcaagcggcccaaattgcgcaatatctattaggtttacgtgtagaatattaaaaaactacgactttaggtaattttcgaagtgaatttcgtacttcgaaggattcattaccttttgtcgtagtttatttgttattattatgttcgtaagtaaccattttcttgtttaacagctaattgaccaactagatttaagtaattgaaaggttgatcaaagttcggagaaaatagcatatctataaaggataattcgtcaatcgtgccgtgataatgcattaaggctgagattgtatccgcagcttgagaaacatcatgtttgctccagagttgtactcccaaaaccttacgggagttacgatcgtaaactaattcgatttcaactttgtgagcattaggcataaagtctggacggtagctacctttatatgccactttagtagcgttaattccagcatccaaagccatggctaaggtcacaccactacaagctaaagtgcgtccgaagattagcattccagttgttgattgggtaccaattgaacggaggcgtttatctaacacattaataccagccaaggccccttggcgaacggcttgtgatgctaatggcatgtaaacatcggtttgcaaaccattatgtttaactgaagcagcatctccagcagcaaagatatcagggttagatgtttccatataatcattaacgacgattgctccattagttagttgatctactttaccttgtaataaatcagcttgaggaagtaagccagtacaaattacagccatatctacttcaaacgcttcgtcggcggtttttacgattaaggtatcgttagcgccatcttcgaaggatttaacaatcgtaccagttttgacctgaatgcctttatcttctaaaagattggtaattttgtcagcaatttcaggttcgatatgacggtctagtagagtctcttttttatggaaaagaataacctcgtggttagatttattgtaaccttcagctaattcaacaccaatatagctaccgccaataatagcgattcgttcatcattttgggcttcgttacataagtcacgagcttcttcataagttttgcatagctttactttgggattttcaacgccttgaatagtaggaatagacgtgagtgaaccagtagccatgattaacttatcgaaagattcggtagtgaattctttagtctctaagtcttgagcaaaaacggtatgttcttcgacattaatatcaattacatcgtggcatagacgcatgtctatcccttgagcccggtagtagtcgggatcagcatacatcgcttcatcaagattagatattgtttttcctaatgttaagtaagtggcgcatgataaatatgaaattgtatcgtgtcgttcgaaaacagtaacgtccgcttgtgggtggtatttcaagatttcattgaccgctgcaataccagcatgggtacaaccaacgacgattattttttctgtcatctgtaatgacacctcttttgtatggtatgaattatgaattatagtatttatatagtatactataacttaaatgttatacatagtatagtatatgatttattttttttaaattatcgaaggaggtattctaaatgcctaagtatcgtttttttgcacaacaacaaattaatacagccacgaatgccgttttaggatacgaactattaattaaggagctaactccagatggctggcgcctaccgagttcatttattgatattgatacaaaagtttttgctaacttattgatagaaacaactaaaatattaggccaaaaggttcgctattgttcagttaacgttaaccgtgaccaattaatgaatactgatattgcagaagcaatcatcgaaagtcaacgtcaactttatccaaccaagttaatcgttgaattaaccgaagatgttagtgaacgcgaatacacacctacagaaataaaagagcaacttgaacgctttgtcagcaaaggaatccaaatttcacttgatgacgtgggtacaggacacaatcagtttgaagatattgaagacttccttcccttagcttcagaaattaaatttgccgttcaaaactttaagtctacaattcaagatcctaaaatcaaacaaaaggtccgtttctggaacgcgattagttctgaatacaatattcatttggtactggaaggcatcgaagaccaagcagacaatcagctaagccaaagttttggtattagccgccgccaaggttatttcttcagtaaaccacaattactaagccttccaggcgataaataaaagtcaaaaaaactactaacctcaaaagttagtagttatttttttacaattttttgctctaagataagcttatataaaacggttcgaatagctatttctaattgagaaaatgacgcgacgggttcttctaaatggctgatttcatgattaaaacgcctaataaattggttgaagtaggtttcaatatcatctgtagctagcaattgtttgatagtatctagcgcaaaagcagttttaaaaatgctaatcatcataatagaagcaatgtggctagcgttgtacttctttttagtaggacgcgttacaagttccatcttgacgtaactattgaccatggttttggtgatttgggtatctaagattggtgttaagtagcgattaacttcttgaatgacttggtccatgtataaatcaaggtctggaaagtctttaaattcgggcaaacgaagttgtttaaaattctgtagccacttttgataattttcttctgtcatcaataaatcctccagctagtatcatagcataaattttattcaaattgatatgcatttcgctttacgtagaatacgattctatgtataataacaccaacaactacataatacgaaatgagggataaaaatgatgcaaacacgaagaagtcagattatatacgaagtttggaatgctgtgacccatggggtggccttttttggtagcttaggcttagttattttattgatcgttaaagccgtcacgcaaaatttatcatctactgccattaccagcttagttatttatggagcaaccttactaatgttatatttggcttcgacgttgtttcactgtttagcctttacgaaagccagacgagtttttcaaatttttgaccatagtaatatttttttgctaattgcagggacttacacgccatattgtattatttttgttggcggaaccagtggaatattgatgttaagtatgatttgggcaatggcgttggcaggaatcatcacccatatttggagtaaaggtcgttttcaaaaggtggaaacaacgatttatgtgattatgggatggatgtgtttgttagcaggaaaagccctatacgctaacttgtcaccaactggattttggttgctagtcgcaggaggtgtggtgtttaccgtgggagcggtgatttatagttttccacgcatcccgggactacatttgatttggcactttttcgtgatggcaggaacgatgctcatgtttggatcaatttatttgaatatataggaagtaatcagatcaaaacacaacaaaaagagatttcagtatgtgatttgtaagaccctacactattgattgtcaaaattttgttcagttttcaaaggtctactattgttgtcatatcaacgttgttagcgcttttgacaactatttaactataccatcgagaacaatcactgtcaacaactttttttaaaaatcatttaacaagtttcttaattatcgatgtgcgccttatcaatgccgctcaaatataataccaagttttcacacctaacgtcaagtaattttatgaaattaatttaatttctcttttttccattgttccatggcgatttctaagggtttaaaaccactaatataatgtgctttggtccaatatttcttatgtccaacatataagttgcttggcttaggatattggtgtaaatctcctttagtttcctttaaagaacgaattgataacgaaaactttttatcaccatcatcctccattacgattgcttttattttttcaccaattgaaaaagtgtttcttagattctttatatacccgtcatcacattctgaaacatgaattaagccttttcgtccattacgatccaacacgaacacgccatacggcttaattccaactatcgtagttgaaacaatttctcctaatctatacataattaaaacctccaatacttaattttacggtaatattcttttaaatacaaaatactctttagaatatgtaataatatataagatacgttcataatttgaaaggaatgatattttgcaagttctcattgattttgttttacacattgattctcacttagtaaccattgtaaatagtttcggagatttaacctatttactcctttttgcaattatttttattgaaactggggctgtaattctccccttcctgcctggcgactcacttttattcgcagctaccgccctttccgcaaaacctgaatacggactacacgtttggatttttgtcgggcttttctgcctagccgctttattaggagattccttaaacttttatctaggtagacacgttggtatggcattaagaaaacaccgtttctttggtaaattcattagtgatgaaaaaatggctgaggctgagcactttttcgaaaaacacggtaacatctcaattactttagcgcgtttcataccaatcattcgaactttcgctccatttgttgctgctggttctaatatgccttataaagatttcatccgttacaatattattggaaatgtagcttgggttgcaatttgctgtagtgctggatatttctttggtaacatcgcatttgtaaaagagcatttctcactcgtagtaatcggaatcattgtggtttccctaattccagctattgtttcctttgccaaatcaaaaataaaaaagcaggtctagttgacctgcttttttactacccaaaatgaaatggctaaatataactccaataaaccgaacaagaaaacaaaacaaattgtaaaaaagttatctgttaaaacattaataattgggtctgtaacgggattaaaaatccaataattgttattaaaaaatgcctgatgaaagagaacaaaccaatggtcaaaatctaagcttataaaaatgactactaaagggaccaatatcatcgagttttgtaatccgccaattaattcccaccacttcttatttttagcaatataacgatatagaattattaccatacaaatagaaaataccattacaatcgtatttagcataaataaatttttcacttccgccatatgaactaaaccatgttcagaaaagggaaaatcatcgagttttaatctatggacccatggaagctctagatatgcaatcaattggtaataattaaccataattttatttgtagacatccctaccagtttagttagatgcgcattgatagtgaacctaaacaaaaaaatagaattaattgtcagaaaaatagcactacttaatcctgctatatccaatagcaagctatataataatcttttccaaaatcctattgccattcatcaaaactatcaacttcatgagtaggtttaatgtcttgctttgcaacgagctctttagttgaaactcccgtatagacaagcaaagtatcaattccaaaattaataccagcggaaatgtcggtcatgtaattatctcctaccataactacttgatccttagataatccagtcactgctaaagctttttccataataatggtttcaggtttacctatatatagggcttgttgttgcgtagaacgttccaataaagcaatcacagaacccgcaccaggtactaatcctcgttcatttggtaaattggtatcagcattcgtaccaataaacttagcgccctttttaatcgctaacgtggcaatttcaaacttgtgatatgtaacgtcatagtctaacccagcaacaacataatcgggattatcttcgtccatctcaaaaccttttgataaaatagctcgcttaagtcctaattcgccaataatataaacttttcgatgtttttgatcagcgataccatccaaatagtctgccgtagccaaagcggccgtgtatacattggatgcttctgctttgatatcatgattgtcccttaagttcttagccacatcttctggtgttttggttgtattgttagttaaaaaaaggaatggaatattatgttcttgcaatcgttcaataaagcgtttagctgcaggaattttttcttttccccgataaatggttccatctaaatcaattaaatatccgccgtaactattaatcttcatctatttcttctccctgattgtaaatgttttttgtcgtttcttcttaccggtccccacaacctcgttatttctctttgatactggtttacgactctttttagtctttttaggttgacgccccttactgtttttctttctaggggtaagtttcttttgctctctcaaccacttatttttagctcgttcattaatttgcatgttccgtaagataaaatatgggcaaccaaagccacaatactcatttaggtaatcttgaactctgctaatcttcatttcactaggtgctaacatatcatcagcataaaaccccttcaatcttagctgtcctgaacctatatctcctaccaaaaaatcatacctactaaataatcctacaaaccgttctgcaagtaactcttcatcaaaagcttctcgatagttcacttctagccgatattcatggtcattgattagaatttcatcatcactaacacggttaaccttattaatgaccggtcttctcatttcagataattcttcatttgttttcttactcatctaaattctccactcatcaatataaaacttatcctaaataaaaaaagaagaaaggtcaacgcctacttccttttttgaaaatcaattttcttaccattgatgatttgttctatgtcagattctgaaaatggcgctccaaatggaatcgcataatctaaataatctttttcaggagtatccacacccacattaatattttccttaatatttacgctgtaatggtggatatgaccatgtaaattaattacctgttttacaattcctaacattatcggataatgactcattattaattggcgatgattcatcttaatgatagtacccacatcatgaaattgaaatttagattgtccatttaacaaataattattagcttgaagatatttgaataaacttcgtgcgtcatggttccctttaattaaaacaatgtgaccattcaaagaattcaataatctgaatatttgttcgttagcccttttttcaggtctcacaaaattcaaagccacatcccctaagtgatacactgtatcccgatcggtcactcgatcattccaatttttaatgattgctgcatgcatatcttcgatattgtcaaaatcgcgtggagcaaagtctttatcttttaacaattctttatgaaaaaagtgtgtatccgaggtgaaaaatttcaatccattagctccccttttcccttaattttcgctaccgtaaacattacaccgaaccaaattaatgatccaattaaagcaatcgctgtttccttttgcaataataatacaacgcccacgaaacttaggaaagttaatacaatataattactaattgggaaaaatggcatactgaattcttttttagcctgcttttgaccttttttatatttcaaatgagctaagacaatcgttccccagataaacaagaaacaggttgtcgcaatactagaaattagtgtaaatactccttctggcatcaagatatttaaaatgactgctactgcaatcactagcgatgataacaaaatcgcatttttgggcacttgacttttagacaaggtacctagtcgtttacctagtttgtttgaacttccataggttaatgagaatagcattcgtccagttgtgaacagtgaactattacatgctgaagccgctgccgttaggaccacaaagttaatgattccacctgctcctgggataccgatattcttaaagacttgtacaaaagggcttccattgggattaatttcattccaaggatagattgccattaagaaaaatagcgcgccaacataaaagataccaattcgcactggtatttcattaatagccttaggaattacacttttaggatctctagtctcagcggctgtcatccctaccatctcaataccaacaaatgcgaataaaaccatttgaaaagaaaggataaagcctttcaatccttgcggaaaaataccgccaaaatgtattaaattagtaaggtcggcatgtcctacgtttgttttagagtgtaaaagtaccataataaaaccaatggcaatcaaagccactattgcaataattttaataattgaaaaccaaaattcagtctctccaaaagcctcaaccgtgatcaagtttagcccgattaataaaataaggataataaatcctggaatccattgtggcacacttggaaaccaatacctaacgtacattccggttgccgtaatctcagccattgcaatcgttatccagcaaacccaatacgtccatcccgtgacaaatcctactttttttcctaaatatttagttacaaaagttacaaatgaagttgattctaaatctgataacagtagttcacctaacgctcgcatgagccaaaaacaaaccaatccagttacaatatatgctaatagaattgacggtcctgctaaatgaatagaacttcctgccccaaggaaaagccccgttccaatcgttcctccaatcgcaattaactgaacgtgcctgctctttaaattccgagccagctcattattaccattttcttccataatcaattcccccagaaatgtttcaaaaattaaaaaatcattagacttttaatagtctaatgatacataaaactttttaattagtaaaacctaaaataagttcttttgagcccatttcttaaaatcttgtaagaaatcaagcattttttcttgattattgaattctgggaattctcctaataaaacttgttctgcctgtttagcactagctccaaccttttgcaaaatgagaattgacttctgcgcctgttcatctttaaacattttggtaggcagattcaaaattgcttgcaaataaactttttcgtggaaaaatgataataattttttagcctcttgagtttgaaataaattacttggaactaggaaaaccccataccctcccggtcggatagtcttcattgattgctcaattaataaatggtgtacaaaagaatgtccctccttgcttctcgtttcaaagcccttagtccgttcgtcaataggataatagccaactggcaaatcagatactgcaatatcaacattctttacaaataaatcatcaatactgtcttgatggaagagctccacctctagtctttcaaaagcaaatgacatgctagcaatcgaaagcatcgtatcatcattatctacaccaattcctttaaaattaattcgtttagtttgaaaataatttaaaattgttgatagtagattacctgtacctacagcgggatcaaaaattgttaattgatttgaatcaacttttaaattttcaataatgtagttaaaaagcattccaattgcttccggtgtaaattgatgatttgcttgaattcgttcttctttgttagcacgaatcataaccaattggatagcttttcgtaattcttccgggctataatcattgtacttaaaaccttcatatattttttttaattcgccaataattgcttcgctaggcttcccgtcttcaacatgaatttgaccagaaattagattgtcacctgtttcaataaatgcatctagaaaatcaacgcccaattcctcttttaaaatttcaattgatttctcgaatgttttataaatcttttcaatagtttctgtattcatttataaactcctcttcactaatagccactttcattaaattcaacctttacagtattaccttttaggacttttatagtcaagttattatcatcatttattttaacagttccatatttcggatcatctaaaaaccttattttttgttttctattctctaacacaaacttatttgctagaatcttagtcttggttatttgttgttcatcttttaacctcagtattacttgccgcgcttgctcaccaatcaagagactaattccagataaaaaagataaaacaaataacgccgtaatcattgcactaccgctttttttgaggcgggatatatacatatgagatactcttctttccatttgaaactaatttaatttggattaaatttctttcttttttaaaaaatacgtgttgcacacccaaaactagtggcatatgtccaggtgtatatctcaacatatcatgattgacataacttcctagataataacgtttctcttcagttttggaatatagagttaattggtcacttctaacttcaaccaattcaaaagcatgctttggtgactccaagtcttggaccacctctgtaatcttcatattaaaattttgttgagccttattttgagcacttttaattaaaagtactgctaaattaacaattaaaaacattatcatcattgctaatacagcttccattaatgtaaaaccactctttttataacttttgtctaatttcatttaatattgtccgctcataacttagttcaatctgttctctatttattttatcgttccacatatgccatgaattcaatataactgtgccaaagcttcctaataaaaataaactaacgattccttcgtataatagtgttccttgtttatttttcggtgatttcataaactccccaacccatttgtgctgataacttatatttaatttttccattggattctagcatcacattgattggtgtgaccgttccatttttaccaatattaatggttcgatcataaaccggctccaatccttcaggtaactccagatgttttgaaattttatgaccattccgataacataaaaaaaattacctcatgcaaattcttctgaaaagttaccgtagctttgtatccatcataagctgttagacgttgtgtatccttccaactcatttcaaatcttctaaaaaatattttttcattattggcgctctgagctcctttaaaaccaccataacccgttaagatcgttccacttgttattaagagaacgatcatcgtctctaatagtgaaaatgcttttttcaaataacagctaactttagcttccgactgcatgtccatcattaatcttaatgccatttcgattagcctgttgaacttgtttatcagataagtaacctttgtcctgtaattcatctaaggacttaggcaactcgttgtattcattttcgtacaaatctacttgagtttgaaccacttgtgtcatcgcatccccttgaatatgtctagcatttttcttttgactagtgacattgggtagaataattaaaattaataatgagataataaataagacgatggtcatttcaatcaaagtaaaacctttttttattttcgctttcattttgacacttccttcattgagttatacattggcattaaaagattcatgtacatcaaaacaatgacaattccgattatgccaaacaagattggctggacaattaaaatcattcgttcaattttttgaatcaaagttttgtatttaatcattgataatgcatgcacttcttttgataatgtttcttttttactccctttacgcagcaataagtctagctcaattggtaaataaaccgatttctttattaccgaactaatatcttgaccactagccatgcttttttcgacccgtcggccaatttgatgaagtaaagactgggaatctaaaagggttaaatacttacaaacacttcccattgacataccgctactaataaaaaatgataaatttgctgttaagtagtaatgacaatatgtttgatacaactggccaaagattggtattctacatagtaaagcgacttgattagccatacttttctttttaaattttaaccataaatataatattcctactataattccaaataacataccaattattaccaatttaatcacttgactttgaacacttgctgtccccgtattccaattagccagttcaggcataatataaattcgcatccctagcatcattattcccaagaatgccattaaaaaaacgggatattgaattaacgactttaacttcttacattgctgactttgactagtaaaaattttagcgatggtttccaaggtttgctctaatccgccgtgttgatcggcaatttctaattgataatagatattagtacttacatacggaccaaaagctgttgaaaatgatttaccacgctgcaactgattaatgaccttttccatgggtttagcaatcgctggacgcataattcgaacaaattccacactcttgcgaatcgaaacgcccattttcattaaatcaaccatagttgaaaaaataaacgcttgatcatttaattggattctatccgtattggaaatcttcaaatacttctttagtaatttggccactttccttccactcctctagtcgttctgtccacttcttctttgttcctttcagggccggatggaatgatttaatttctgccataatttttaaatcaccaaccttagcaggaatcattctttgatagataactgccgttaaggcttcttttaagtgctcttctcgtacacctaattcaacaattcgattccataccccttgggtacttttagagtgaacggtggttaaaactaaatgaccacttaacgcagcttgaatcgcaatttctgcagttttaccatctcggatttcgccaataataaaaacatctggtcgattccttaaaccatttttcagtaattcttgataagacatccccgatttttcattaacttgcagttgcaaaaaattatgttcgcgaatttctaccggatcttcaattgacattaccatcttggtttcacttaatttacgggctacttcgtaaattaacgttgtttttccggagcccattggacctgaaaaaaccattaatccccgaagcttagttgctagttggattttttccatactttcgctatccaaaatatgttcatcttgctttagtacatatataaaacgaattaccatcgaaggtcgatccaaaaaatcgcccaccgtagatattcgtaaattaactaattctccctggcggtttaaccaagtcatcgccccactttgtggccttcgtcgctcactgatccccatatcagcccgatatttgatatacatcataatttgttctgcttcatctctatcaatctgggcagactttcggtaccctcccgcatctcgatataataattgatatttatcaaatcgcggcataatgaataaatcactatcccgattgacaagacactcttggatgatttgatttagcttactggttatattcatctcacgtcctcctcaccgtatatatactcaaaaacagaacatttattttttaattagctaaatttagacaacaaaaaaacatgaacctgaatggttcatgtttttttgttatgactatttattttagaacttctttgcgtgttggaattgatggttgggcacccatcttttgaacagccagcgaggaagctttattgccatacataatggcttcttttaagttacttaaatctggcttcaattccgaactaaaagatcctaggaacgtatctccagctgctgttgtatcaatcgcatgcactttaaacgccggaacaatgccgctcacgtcgccatcatcataataaacccctttactacctagggtaataatgaccgtctggactcccattttatgtaatctttgagctgcttctttcattgaagcatcgtccacaaccgtaacgcctgttaaaatttcagcttcagtttcattgggcgtgataacatccgtcaattgaattaattccttaggtaaatttttaactgcaggagcaggatttaaaattgttttgattccagcttgtttagcaatttcgaaggcatatttagttgtttcaagtggagtttccaattgagcaacgataaaatcagcttgttgaattttttcagctgccttattgacatcatcctcatttaactcagcattagagcctccataaattaaaattcgattttcaccggtattttcgagcattacaaaagcttgacctgtatccgctactttggaggttgccacatattccgttgaaaccccgctatcaagtaattgtttaagcataaattgcccattcgcatcggttccgactttaccaataaaactagtttctgcacctgaacgagccgctgcaattgcttgattggctccttttccaccaccggccatttgcttatcttttaaagccaatgtttcccctggttctggaaaccgtccaacttgtaaaattgtatccacatttagactgccaagaacgaccactttattactcattacgccacctcagttatatgttatataagtaaattttatcatactaaattttcaaattcttgattaaataaaaaaagcaagaacttaattgtccttgcctttaataattattattcagcgtcttcaggtaatgtagctgcttcataaacttctgaaacatcatcattatcttcaagttcatcaattaaacctgtatattgtttaactttatcttctggaaccattgtttcgttttcaggaatcatggttaattcagcattagccaatgtgtatccctttgcttcaagagcatcacgaacagcagcaaattccttaggatcagtatagatttcaaatacctcttctgatgtttgtacatcgtctgcacctgcatcaattgcatcttccatcatatcatcttcatttttatcaaggtcttcacgactaataacaatgtaacccttacgatcaaacatgtaagaaactgaacctgaagcccctagtgaaccaccatggtgagtgaatgctgaacgaacagcagctgcagtacgattcttgttatctgtaagagctgacacgataatagctgtaccagctggtccatatccttcataagtaatttcttcgtagttagcaccacctgcgccactacccttatcaacggcacgtttgatgttgtcttttggcatatttgctgcgcgtgccttatccatcattaaacgtaattgagggttagaagaagggtccggacccccagctttaactgcaacataaatctcacgagagattcgttggaaaattttaccacgctttgcatcttgggcgtttttacgaccttgaatattatgccactttgaatgtcctgacatacccgaactccttctttcatttcaattttttatctgttcatagacgtttaatatattacgtattatagtggggtttgtcaatgcttacattcaatcctcaccttacccttttccattgttcgctaacctaatcgaacgcatcatcgaaatgctaacaaactttccatcacctaaatatacagaatcttcattaaatcctttaatacgcgattttattgcattttcaaagagtaaatcacggttacattcatttaattgaatttcaactaatagttgctcttcatatgcccgagcaacttttaatctgatttcaccttgtttcattctgggtggaattttttgctcataaaatattttgttatcatttctcttacgtttaattgctacagtatgatctgaaagaaaaaagccttgccactttatcattcctcgatcaatatacacattatcaaaaaagttttgaactacttgaggatcatattgattatttttattattcatctctacgcctctttttttgaataactttttgactagtaggccaaagttgattttcaaattgaataaattttatagtaaacttccagcgttgctgaagcccgcgtacaatctcttctagatctattaatgtatatttttcaagcgtatgaattggaatagaacgttccctttgccctcgtcgttgttcactaaaaaaaatattataagaatgatcatagatatcattaacaattacaatccaaaattgagtgttaaattttgaaacattaaacagtgtttcaattcgctgattaattaaagttaattcttgttgcttattcataagcattccccccattatgtccacctactaggctggcccgctggattgcagtaccacctttagttaagctacgtgcgtaaactaaagcggtaaagccatattcagctctgatctggtcaaccagttgatcagtttgatgtttggaaatcctcggaaacggttcgaatagattcaattgttcaccaatctgatagctcaatttagcagtaaagatagctatattacgaacaggttgccctttccagtacttttggaaaatctccttagcatatttaaaaatttctacattactattagtcggaataaccttcaatgactggctaaacccactatttatcgtagactggtaactaaatccaatacttaacgttagctcaccacattgttgacaccgatgtcgtaaccgtgcagctacctgctcactaatctctttaattacagtttcaatttcacattgctgctgataatttctaggtaacacttgagaattacccacactattttctttaggttttaccctttcacttagaatcgttcgatcaatgccccacgctgttgcaaacaattgagttccaattattccaaactcttgttttaaaaaatatggattactatgtgctaactcattcatattgttaatacccagtttttgcaaacgctcggtcgtccgtcttccaattccccacacatctgtcaacttaggaatcatccatactttttgggctactgtattgtatgtaattgtgccaatcaaatcattggattttttagcgaaattatccagtgctagtttagcttgcaatggattttcaccgacaccgattgttgtgtataagcctaactgcctacgtactttatgttgaatttttttagcaacttcttcaggagtttctccaaaaagtttccaggttttagtaatatctaaaattgattcatcaatggaatatggatataaatcttcttctgccacatactgtttaaatatttcgttaatttgaagattacgcttaatatatagattcattcgtggtgggaccattataattcttggatcacacggtaaatccctttgtcgcgagacgttagctttcaatccaaaaagttttttggccatcggtgatgtggctaaaattagtccaccattggtattttcctgctcagaaattactaccataacaacttttaatggatttagcccgcgcataactgcttcaacgctggcataaaaagatttattatcaatcattaaaaaaacacccttgggttctttatcataattcattaaatccgcctccacctctaattatacgaacacacgttctttttgacaagaaaaaaataaaaaacgcttcttaaaatagaaacgtttcttatcaacgagggggcgactatcctgattaaaagatagcagaatatattaagttttgggacaatgtaatattattgagctattgctagcttttgagttagactcattgatttggggggtcaataagtattttatattctagtttcgccacttagtgctcgttttcttcattataaaatcattttataactgcccttaaacgtagtttttgctaactacaaatttatcctaacatacccgctgatgatatgcgatgcttatttctaaatcgggtaaaatatctattactccttttttcagttaggctccaagcgaatcattcatctgtcaaaaaagccgacaaaaaaaggattaatagtattcctactatcaatccttttggacaattatgcgcgttttgtataagttcctttttcagtattaattaccagaacttcgccttcttggataaagtctggaacattaactactaatccagtttccattgtagctggtttacctgaaccagtaactgtagctcctttaattgatggtgcggtttcaacaacttttaattcaaccgttgttggtaaatcaaccccaattacttcattaccatagaaactaattttaaccattgtattttctaaaagatattttaattcactttcaatacttgatactggtaattcatattgttcgtatgtttcagtatccatgaaaacagccatatcatcttgacggtaaagatattgagcttctttagtatcaagaatagcttgttcaactttttcagttggacgcatagttgtttgaacagttgatccagctcgtacatcatataacttcatttgcattactgtgttacctttaccaggtttatgatggttagtttctacaaccttaatcaatttgccatccttaatgaatgtcatacctgcttttaaattaattgcttctaccatatttaaaatccccttttatttattaatttctataatttttgatttttcaatccccagactagttaggcgggattgaaaaaatactactaattatttttaacataaagttcatcattaactccgctctaattcgacttaatacttcattctatcataaattaggctgcattttgactactacataaaaaggaacctctgaaaaaataattttctcagaggttcccatttacatcaatcctattcgacctgagcacctagtgcattcttaaaatgttctagtgcccattcttgaccatgttccgtaaaggttgccacacctttttcattaataataattcgataacctaaattatatgcatcaacggcagtatgaaggatacaaatatccgtacatacccccactagccgtactgtatcaattttacgagctcttaactgcatatctaaatcggttccggcaaaagcactataacgagttttatcgaggaatttcactcgttggttagtcttatttaaatcataccaatcttgcaactggccgtaaaaatcgcgtccccatgtccccttaagattgtgtgcaggaaataatttagtttctggatgatatggatcgccttctacatgtacatcagttggcaaaaatacccaaccgtcttcacgtagctcttggttcgccaacttgataatctctgattcaatcttttgtccaactactcctgtagttaacgcaccatttgatgccacaaaatcattcgtataatcaattacaagtaacgcttcatttgattttttcatcaaaattcctcatcccttttaatctaaattatgcttcgatgccacaccgttggtagattgcatcaacgtttttaagatggtattgatagttaaaaatagctcgaatttcttcatcatcaagaattgacttaattttatcattttcaagtagtaaattcataaaatgttgcccagtattccacaccatcatagcgattggctgaactgtatcgtaggcttcctcgcgggtccaacctttatcaatcaatttcaacataacttgttgagaaaaaatcaatccatgagtcatttcaaggtctttttgaacttcatcttcattaactaccaagttatttaaaatccgattcattcgtgtaagaatgtagtcaactaaagctgttgaatctggtaaaattacacgttcagcagacgaatgagaaatgtctcgttcatgccataaattcatattttcaaacgctgtcatcatttctccacgaacaactcgacttagtcctgaaacattttcagaaccaataggattacgtttatgaggcatcgctgatgaacctttttgtcctttagcaaatccttctcgcatttcattgacttctgtacgctgcaaatgtctaatttcagttgcaatttcttcaatttgggaggcgattaaggccaaaacactcaaatattctgcgtgtaaatcacgtgggaggatttgagtcgaaatttcttgatgcccaattccaagcatttggcaaacccattcttcaatttgaggagtaatgttagcaaaagttcccactgccccactaatcttaccaacttcgatgtttttacgggcatgattaaaacgttcaatattacgattgatttctgaataccagcgtaaaaattttaatccaattgtcgttggttcggcatgaattccatgagtccgtccaacggcaattaaatctttatatttgattgatagttctttcaaggttgtttttagtgtttctaaatctgccgaaatgatttcattagcagctttgagtcgaagcgactgcgctgtatcaacaacgtctgtactggttaatccgtaatgaatccattttcgctcttcgcctaaagattcggaaacggacctagtaaaggcaattacatcgtgatgcgtttgactttcaagctcatcaattcgatctaaatcaaacttagctttcttttcgattagttcgagatcttgatcaggaacctttccatccttattccaagctttaacaacggctatttcaacgtcaagccaactttgaaattgggactggcggttccaaattttttgcatttcgggtcttgcataacgatcaatcatttgattactcctttgaattaaaaatatttacctcttcattttaccaaaatcttcagtattaataaacacgaaccattaaaagaattaccttttgtataattcggtttatcccttttattttttcggtaaactgtgttatcatctttagagttgtgtattgataaaaatggaggaataaatatgacagctacagtagtaataggaagccaatggggcgatgaaggaaaaggaaagattattgattttcttggacaaagtgctgatgttacagtgcgttattcaggtggagataatgctggtcactcacttgtggttaacgaccaaaaattagctcttcgtttaatcccttccggaattcttgctcctaattcaatttgtatcattggtaatggaacagtgattaatcctgctaccctacttgatgaaattaaagaattaaatggagtaggtgttaacactaatcatttaaaaatttctgatcgtgctcatatcgttttcccatatcacatcttacaagatcaacaacaagaacgtgatcgttctaaaaatggcgaaaaaattggaacaactaataaaggtatcggcccagcatacatggacaagatgcaacgtattggtatccgagctattgatctattagacaacgaaactcttgaagaaaaaattgcttttaaccttgaacaaaagaaacgcattctggacgaagatctttggaatcaacttccaagcttaaaggaattgaccgctcagtacattgaatatggagaaatccttaaggactatattactgatacaagctacctaattcacactaacttaaatgataataaacgcgttttatttgaaggagctcaaggtactatgcttgatattgaccatggtacttatccttttgttacttcctctaatccaactgccggtggagctgctacgggtgcaggaattggtgtaactaagattaaacacgtcattggtgtatgtaaatcttacgtttctcgcgttggtgaaggcccattcccaactgaacaaatcaacgaagtcggtgatcgaatccgtgaaattgctcatgaatatggtaccgttactaaacgacctcgtcgaattggatggtttgatggcgtattaatgaaatacgtttcagaagttaatgggctaactgatttagttgttaactgtttggatgtcctttcaggatttaaagaacttaaaatctgtactggttatcaaactgatcacggcgtaattaagtattatcctgcttcagaaaaagaacttaaaaattcaactccaatttatgaaactcttccaggttgggatgaagatcttactcaaatgactacttacgaagaattaccagctaatgctaaaaattatcttaaaaagattgaagaaattactggagttccagttagcgccttttcaatcggccctgatcgtgaacaaaccatcgtcttaaatgatatgtggtcagactaaaataaaaaaagaagtaaaaatcattaacgatttttacttctttttttattgacctgattagccccaaaagacaacaccaataaaatgattcctaatattaaaataccaagtgccatagttaactcacgtaataaaatatcttgtcctgcttgctcaacaatccctttaattacagcatattggattggcaaatcattaagaacatttgatacataggcgatggcactaatcacagtagcaaatgccccaaccgtcaccatcatggaacctaataaattgagaccgcgtcgtttaatgaaagcaaagaatgttagtatcagcagtcctactgcactaatcgccatcatgatttgattcaacttttgtaatttagctacctgtcccgcataatgcgttagtttttgcgtatccaactggctattaaaaatattagcaacttgattaacaataatcgaaactatcccttgttgtatcattccggacgtgccaatatttgcattaacttcttccataatgattgattgatctaacttgacttcctcaccagcataaaattcaccaatcattgacttcaattcatcattaattacattatcagggatcaaattagtctgttgaatccctgcttgttgcaattgtgtattaacttgctgattaattgtactagccgcattcgatttaaccacctgactttgaacatagtttacattaaagacggtttgtttagctgagaaagttaaaaatagtaataacccacaaataatcatcaagactcttatccaaaacagccttggttttctgtcaattgtcggatttttttcttgaagcgtttctcttgtcatccttgtttcttcgattgggaccactcctccattaagctcataatatatcttcattttaccactattccgtaatctctcattactcttcaagatatcttaagacttgctatacttgttttcatccaattttcttgttttttgagaaatgttaagaaagctttacatatcgcccttgcatattgcctttcaaataagatatactcataaacagtgtgttttacgtaaattttatttttaaggagttttacataatatggaatatagtttttttgccaagttagcagctgaatttcttggtacagcaattttagttcttttaggtaatggttcggttgctaacgttgagcttaaaggtacaaaaggtaacggtagtgattggttagtcatcgcagttgggtacggatgtggtgtaatggtccctgcattaatgtttggaactatttctggagctcaaattaatcctgctttcaccattggtttagcagtttcaggaatgttctcatggtctcaggtccttcctttcattattgcccaaatgttaggtgctattttcggacaattagtagtttattttgcttacaagcctcattatgatttaactactaatactgaatcaattttaggtacgtttagtacaattgatgctagtcatagctcttggaatggttttgctaacgaatttattggttcattcgtcctcttctttggggctacagcctttactcatgctccttatttcgaggctaataaaggatcagtatttattgcacttggttttctagttggtactttggttgcttcacttggtggtgctactggtccagctttgaatcctgctcgtgacttaggtccccgtttagttcacgcaatgctcccaatcaaacataaaggatcatctcaatggggttacgcatcagttcccgttgttgccccaatcttagctggtatttgtgccgttgctttgtataaaggacttttcctataacatataattaaacaaaaaatccgcttctacctaatgtagaagtggattttttcttttatttagtagattgtctgaagaccatatcaaatggaagagtaatattacgttcttcgacttcttctttattcattaatttagttaaaagacgcattgcaaccgccccagtatcgtacattgggtgaccaattgaactaatttgtggacgaaccatcttagtcaagctagtattattacttgaaataatttcgaaatcttccggaactttaacgccgagatcttgaaggccgttaagtaagcccaccgctaaactatcattagcaacaaaagcggccgtaacgcccgttgtagaagcaatttcggatgctaacttaactccatcttcgtaagtattacttgtttcaaaaactagattttcgtcataatcaactttagcttcacttaaagcaagacgataaccttctaatctaaatttaccattaacgggttcagaaagcggacctgagataaaagcaatcttcttatttttattatcaattagtttattgactgcttcgtatactgcagccttattatcgatacttacagaaggcaaagtgttcttatcatctacggaaccagcaaaaacgactggtgtacgagctgctttaaacgcttctcgtaaacgatcgtcaacggcattccccatataaatgataccgtctacttgcttagcttgtaagttttcaagcacttcaacctttttatcaacatcttcgtcagaattttctaaaatgatattgtatttgtacattgaagcaatatcatcaattcctcgtgctaacgatgcaaaaaacatttgagtaatatctggtagaattactccaatagtagttgatctcttgctagcaagaccacgagctactgcattgggatggtaatccaaacgttcgattacttcgttaaccttttttcttgtaacaggtttaacattaggatttccattaacaacgcgtgatactgtggccattgaaacgcccgcttctcgagcaacatcgtaaattgtgatggtttgttttgccatattatattacctcttccattgatattatttgttttcattctgttttcattgccatgaatacgttatcaaattttcagcatacttgcaacctttttttattttattacctatttccctatgtgctataatctaactatccgaatataagaaagaagagattaaatgtcacaattagataaagtccaagcatgggtttcagatcataagttagacgttgcatatattagtaattttgaaagtattaaatacttaactggttttggtagcgaccctatcgaacgcgttttagctttatttgtttttcctgatcatgaaccattcttatttgctcctgcactagaagttgaagcaattaaagatactggatggaatcaccccgtttatggttatttagatcacgagaagccctttcaattaattgctaaatatattcgtgaacgcaatgctaaccctattcactggggaattgaaaataataatcttacatttgatcgttatgaagtacttcgttctgaatttccaaatgctaaatttgaacaaaacttaactccagtttttgaaaaacttcgtatgattaaaactgccgacgaaatcgaaaaattaaatgctgctggtgcagaggctgattacgcctttgaagttggtttcaatgcagttgccgctggtaaaactgaagctgatgttgctgctgaacttgaatatgctttaaaaaagcgtggtgtaatggaaatgagttttgatactcttattcaagcgggcgctcatgctgctgaaccccatggtgcaactggcatgaaccaaattcaaaataatgaattagtacttttcgacttaggtaccatccatgatggttatattagtgatgcttctagaacggtcgctttaggaactttaaatgacaaacaaaaagatatttacaaagtttgtctagaagctcaattaactgcccaagcttacgccaaacctggaattactgctgctagtttagataaagtcgcacgtgacatcatcgataaggccggttatggtgaatacttcattcatcgcctaggacatggaatgggtatgggagaacacgaattcccatccatcatggaaggaaacgatttaatcctccaagaaggtatgtgtttctcaatcgaacctggtatctatatccccggcgttgctggtgttcgcattgaagactgtgttcacatcactaaggatggttgcctaccatttacccatacttcaaaagaacttagatatctataatatttctatcaaaaagcacttcggttctaagccgaagcgctttttatatagcctaattattcggcagaatattgagctaaatattcatcaaatggcttcaattcttctgcatcccattctttaagaaattcaggtgtatacaatgtatcgtcctgttccaaatcaagttcaactggaattcctcgtttatccgtgatattggcatcaattaacaccggatgtccagcttttacttctgcaatagcatcatcaaaggctttttcgagctgactaatttcatcgactcgaattcctttaacacccattccttcagcaattttagcatagtcagcatcagttaaatctaccccgaattcatcttgaggaacgtcatcttgttcagacttaataaaacttagatggcggttagatgtaacgatattaatgattggtaagttataacgtttttcggtaatcatatcctgcattaccattgagaacgccccatctccagcaatattgaatacttgacgatctggatagcttaacttgctagccattgctccaggaattccacaacccatagttgcaaacaaagctgaagttaagattttttgtttaggattcatatcaagaaaacggaaactattaataatattatccccaacatccattgaaaatacggcgtcgtcatctgcaattcggttaatttgttgataaacttgttcgtattctagaggtccatctgtccgactcatcaagccctttaggtatttacgccagtctttttgggcagccacagctgctttgtagaatggacgcggttgaacggtttcgctaatttcatccaatttttcaacgaataatttagcatctgcccaaattcctaaatcaagtgaatgatggcgcccaaaaatagcttgatcattatcaacttgaatatacttaaatggtcgatctccatatacaattgctgcaaatgggaagttagcaccaattgaaattaaaaggtccgttttcttaattaattcattagaaaccttagaagccgctcggttaaatggccccatattcccctcatattcatcagggattacgcccttagctaacccagtaattacgattggaatttgaagtttttcagataatgcctcaacttctttggtggctccgcgagcaccttgtcctaaatgaataactggatatttagcatttttaatcatatcccaagcatcttgcactaattcagaatcaggttgaggtttaatctcaggttgattacgtgttttttcagtagaataattgccagttgggatttctacgtagccaaagtcattcggaataataactaccgctactcccttttctttatatgccatacgaatcgctttatcaattacatatggcaaactttctggggtcatcacaattcgattgtaaaccgcaacgtcatcgaacataggagattcattgaattcttggaagtaatcataattcattcgggtatgtgggacttgtcctacaattgccaaaacaggaacatggtcttcctttgcatcatacaatccattaagtaggttgactgcgccgggtcctgctgacccaaaagctaccccaattttaccagtcaatttggcgtcagctgctgctgcaagtgccccgacttgttcatgtcgaacctggatgtatttaatattgtcttgttctttttgcaaagaatccatagttgaattaattgatcccccagggtaaccgtaaatatggtctacaccccatgattcaattacttttaacattgctattcctgcttgaattttttctgccatgaataatttcctcctcagctttttgaaaacgttttcttttttcatatctgattatttatcttttataagtaaaaatcaataaatatgcttaccgagtaaaatcatcaccatttcaaaataaaaaagatgaaaactagcaatagctactagtttccatctttttttatttattcttggattttgtgaggcataaatacctcagtgggtttttcatatggagtcgcttctgccatgttatcaataactaaatcttcatccatctcttctaaatcaggattaaatttattgttagcacgattagctaattccattcctcgttgttttaaatcatctacagatgaaactgctcgatctttaagcgtagctgtatcaaaatcattggattccatgaaatcatcaaatttctcaatagcagcttccttaagttgttgaggtgttgtatctgttaacttaattgctgctgcagtagcagctgctccacccaagattacacctagtaaaaaactactctttgacatactgatagccccctatttattcttaactttatggttcttatacatattcatagcacctttaccaacattcatggctgtggctactttaccgatattcttgctttttccagtatggtttacccgaccagctaaacgacgagttgcttggtttaaatccgatgtactttcactcaagtcagcaaccgcttggaacaatggatcgatggtagcgacttttccgttaacatcttctaaaagttcgttcgcatttgccataataccttcagcttcatgtgatataagatcaacatcccgtgtgatcactgccatactacgattaatctctgataatgttttagaagcattcactaatactaatccaatgaatagaactaaaataagcaatgctactgcagcaataattgcagcaattccgcctcctgtcaaatgatcccctcctgttcgtttatgactacagaatagcattacaaataattaagtgcaattaaaacccctacatattcgctacaaaattctgttagaatagtattattactgaaaggacgatttttatttatgaaaaacatgcttactattgcagcaggcttcccatcattaaaatccagctttactcatattgattgggaaaaaattggtgtagcttttatggaacattttttccaactcgttctaatcaccattattttctggattattaatcggattggtaaacatatcatccgtaatagttttcaacatcacgatccaattgaaaaacaatccgctcgttcacaaaccgtttacgcagtggttaaaaatattttcaagtattccgtcctattcttttacgtctatactattttatcaaatttaggagtaccagtgggcactttattggccggtgctggaatcttaagtgttgcaattggactcggaactcaagggattgtgtccgatgttattaacggcctaaccattttaattgaaggccaactacgtgttggtgatagtgttacgattcaatccatcgatggaaccgtcgtttcaatcggtttacgaaccattgaacttcaagcacttgatggtactttacattacctgccgaatcgctccatttcaacaatttcaaatcattctcgcggaagtcaaactatttcgatctttctacgaatcagtgatccgtttgaaattgaccgtgctaaagacttgttgcgtgaccaactagcttcgattaaacaagacaccgataaaattaaagctactcccattgttctcgctcctgtagtcgaaaagacttacggatatctgggagttcaaatctctgccaaggttaaggccggctatcaaactccgatgaaaactatgattttggatcgttgtctacgaactttagcccaagaacaaattaaaattcaaaattagtaaaaaagtatgccatcttataatcacccaaagttagatccaattcactctactacgggttcaatgttgatggcatacttttttatttattcccagaatttatcaaagtttactaataaatcttcaattgctaatgcacgatggctaattttatttttctcttcacgcgtcatttcagctaaagttttattctttgcttccacaaaaaataaaggatcataaccaaagccgttgtcaccgcgcggaacagcaagaattcgtcctcgtagatttccatttgccactaactcacttccatctggtttgcgcacaactacggttgaatgaaacgttgctgtacgtttttcatctggaatgccacccaattcgctaagaactttggcattgttagctgcatcattgtgatcaccggcgtaacgcgccgaaaaaattcctgggcgtccattcaaagcatcgatttccaaacctgaatcatcggcaaggactggaataccaattgatttagcgtatccgtctgcttttaaacgggcattttcttcaaacgacaagccattttcaactatttcaacgtcatcattaatatctttcagcgattttacaacaatgcccttttgttcaaaaatttgtttaaattcttttaattttccatcatttttcgtggcaatcaaaatttcattattcattctaatttctcctagtcaattttaacttcttcaactcttagatcttgatttaagaatgtccgcgctatttcttcaaaattcttaatattacccgttgaataatattgatcctgcgctttaggaccttctgcatgttgaagcgcttgttttgttaaaatttcaattaattggtgaacggtctccactcctggatctactaaagtaacatcaggcccaacggctgcttggataccttcttctaaaagcggaaaatgagtgcagcctaaaatcaaagtatcaatttgatcttgcctaaactcagctagtttttcattcataactttttgagctgccgttgtatgaagttcatttttttcagcaatttctacaaattcttggcatgctaccggataagcgcgtaatttggtattaatttcagctaaagcctttgggtaagcctcagatttaattgtgcctagtgtagcaataactccaattttttgatttttagtttgcctattagctgcaattgcgccaggtaaaatcaccccaattactgggatgggtaattcagcttgtaaaaccgctaacgccgcgttggtcgcagtattacatgcaatcactagcgccttaatatttttagttattaaaaatgacgccatctgtcgtgaaaattcaacgacttctgctgtgggacgaggaccatacggcattcttgcttcatctccaataaagataatttcttcattaggtaacagtttttgagctgttttgacaactgtcagaccaccgacgcctgaatccataaaaccaattggacgattatccattttaattcccccactaaataaaattatacatacatccataatactaaatttcagtaaaaaaagggagcatgttacccacctaactctataaaaaaagaaaccaattattgataaattggtttctacttaacctcaatttaattaaatgtattggtctaaaatcttagctaattgttctttagaatggtatcccacgattgaatcaaccactgctccgtctttttttaccaagagtgttgggatactcataattccaaagtttcttgctgtttcagggttttgatcaacatccatcttagaaaatgaaactttatcgcccatttcatcagcaagttgttcaactacaggtgattgcatccgacaaggtccacaccatgtagcccaaaaatcagttagtgttacgccagtatttgttttttcttcaaaatttgcatctgtaatagcttcaaccattctaattaccctctttcacaatttgttacgttaactataccagtctttgcgtagcaaatgaaataattagcttacattttataaggattatttaaaatgaacaatcgtggcaccatttccaccagcattcgcaggtgcgtattcaaaagctttaattcgacgattattcttaagatacttggtaatcccacttctaagtgccccagttccttttccatgaacaatcgttacctcgtcataacctgctaacaaagcagcatcaatgtagcgatcggtttcagtcagtgcttcttcataacgttttccacgtaaatctaaggttgttttaactcccgcagaagccgttctttgaactgagttatgaactcgtcgcttgaccgtcttatccggtttaactttttccagttcatcaacggcaaccttcattttcataattcccatttggacttcccaatgttttttatcaacttgccgaagaagttccccacgttgtccataagttaagaccactacttcatcattttcatggaatttttgagcttctttagcgcgtcgtaaaactttattacgtttaaggttagtatcctgatgaagggcgttaattttacttttagcgtcgattaaatcattttccttaaaacttcctgtggaatgttctaacttacgtagacgtttaataatgcggtctgcttcggcctgactatcattcacaattcggtttgcatcttctttagcactctctattaaattgctccgttgcgaatttaggctatcgactcccttgaccaaggtttggtggtactcctcggcttgtttaagtaattccacagcttgttgattaattttttgagctcgtttttgacgagtcgttaaatctttaatcatattgttcaaatcttggctatcttggtcaactagcccccgagcttgactgatgatatcactatctaaacctaaacgttttgaaatttcaaaagcgttactctgaccaggaattcctaataataacttataggtaggctgcaaggtatcaacatcgaattccatactagcattaatggtacccattctttcatatccataagtctttaattctggataatgggtggtagtcattgaaacagcccccgtgctgcgaactttatctaaaatagcaatcgcaagtgcagccccttctttaggatctgttccggcacccaattcatcaaataatgccaaggaacgttcatttaaattgcctaaaattcgaattgtattatccatatgggaagagaacgtactcaaattttgttcgatggattgctcatccccaatatcagcaaatatttcctcaaaaatccgaaccgtactattctcattagctggaataaacattcccgactgtgccattaattgaaggagtcccaccgtttttaaggtgatggtcttaccaccggtattaggtccagtaatcacgagtgtctcatactctccacctagtctaatatcgttggaaactacctttttttggtcaatcaaaggatgccttgcttctcgtaggttaatttcattggacgctgaaatttgcggttcagttgcttttagttgatgagcatactgggccttagcatttagtaaatctaaatggcccaaaatgcgactattatcttttaatgtatctgtgtaaggagctactaatgcactaagttcttgtaagatgcgttgctcttcatggacttctgctacttggttttgtcgtaattcattattcaaatccactactgattcaggttcaacgtataatgtttgtcctgatgaactttgatcatggactactccaccaaatttagaacgatattcaacacgaactggaataacatagcgttcgtttcggatagtcacgattggttcacttaaatacttaacattatttccacgtgtgaatttttccattcgtgaacgcacatcactctcgatacgggtaatggaagcacgaatccgtcttagttcgcttgaagcggaattcaacaaatgaccgtttccttcaattgaattacttaaacgttcttcaacttcaggaatagttactagttgctcaatcacttgatctagtgcaatgatttcaatttcttcattttctaaatcatcgaaaaagttaattaccgttcgtgtagctcttagaattctaccaatttgagctaattcttgaccgtttaaagcagcatcaatcttcaaacgttgaagtgcctctgtcacatcttcaagccgcggaactggaataccattctttaaacgataaatattaaccgcatctagtgtttgttttaaggcgtttcgtacttcagtttcatcgctacttggtactagctcacgtaactcttttgttccattttcagtagctataaactgccgaatagattgtttaatcttgtcatactctaaaacatctaaaattttcttattcatatcaatctcatttcatttcaaatcaaaaacggcccgctcgccgatagataatatctcatcgtcaaacaaggaccgtttctaggaaattaatcttggtcttgatcaccaaggaatgtattcaagacttcttcgaccatatcccattcttcatcagattcaattggaatcaattccccttcacctaagtcgtgattttcatcaggcataaaggcataagcttgaatatcaacctcttcatctgcttctgcttctgatgggtaaagtaagacgtatgaacgaccatagtcctctgaatcaaacgtaaatagtacgttatacaattcttcatttccgtgttcgtcaacaagtgtaattttttgttcttcgttatccatatgcttgtcctcactttaatctatcgattaattttccatgtccgtttaagtagttttctaaaatcaggctagctgctaatttatcaatcactttttttcgctttgaacgagaagtatctgcttgctcaatcaacatgcgctcagcttccacagtcgttagccgttcatcttgaaaatcgatgggtaatccaaaagtttcttccaataacttaccatagttacgtgctgcttcaactcttggtccctcagtgttattcatatttttaggcaagcctaatacgaaacctacaacatcatattcttttactaattctttaacgcgttcaatcccgaagatttcttcatcttcattgattggaacaatctcgacaccttgagcagtccatcctaactgatcactaactgaaattccgactgttcttgaaccgacatccattcccattaatctcattaattttcttcctttttgctatcagcgatttgttcagatagatagtatcgaacgagttcttcgataatctcatcgcgctgatgtttccgaatcaaattacgagcatcattcaaccgtggaatgtatgccggatcacctgaaattaaataaccaacgatctgatcaatagggttatatcccttctcttcaagagcatcgtagactgtttttaaagtttctctgacatcgttttgcttattatcgccaaagtcaaagaacattgtttcatcaagttttcccactgttagcacccctcttcacatactagtcctaattttactttattagcacctaaatcacaatgaatggagcttctcgtaactaactcgtaatattatccattttgactttctagccattctcgagcggcttgcaaagcagccttgatattatccggattagaaccaccggcctgagccatgttcggacgtccaccaccgccaccgtttactttaggcgcgattgctttgattaaatctcctgctttaagaccttttttaacaaaatcatctttgacagcagcaattaaattagccttttcaccaatcttagcagctaagactaggacatcggattgatctttatttttccaatcatcagccatttgacgtaattgatccattcctgaaacttgaacatcagcagcaattaaacgcactccgttaatttccaccatttcatcgccgatattagcagcttgggatttagcaatcttagcttctaattggctaattttttgtgtcaatgctttaacatttgattgaagttgttcagtcttagtaggaacatcttttaattgagcactcttcaaaagaccagctgtttgcttcaaaaggttttcttcagtatttaagaattcaagtgcagcctgtgaagttacagcttcaattcggcgaacgccagctcccacaccggattctgaaacgatcttaaagagtccaatttcattagtattcttgacatgggtccccccacaaaattcttttgaataatcgccaataccaacaacgcgtacctttttaccatatttatcattaaacaaggcaatggcgcccatcttcttaccagtttcaaggtccgtttcaaccgttgttactggaatttcatcataaattttttcgttaataattttttcgacccgatccaagtcttcgttagttacttgtccaaaatgcgtaaaatcaaaacgtaaataacctggttcaactaacgaacctgcttgttgtgtatgatcgcccaaaatatcacgtagcgcttggtctaataaatgagtagctgtatggttcttttcaactttcaaatggaaagctcggttaacttctaatgtataagctgctccgctgtgcatcttctttaaagctttaatagtatgcaagttttgaccattaggtgcatgttgaacatcaatcacttccgccacaatttcgccattggcatccctaatttcaccttgatccgcaacttgtccacccatttcagcatagaaaggtgtgatattaaataagacgcgggcttcacccggttctacaatatctgttaatttcccatcctgaattacattttcaaggattgcattatcaactcgaagagtatcataaccaacatatttactttcagtctttaaatccgttaataaatcagattgaactcccattgatttttctgttgatcgagccgaacgggcacgttctttttgcttctgcatttcatcttcaaagcctgcttcgtcaactttgagccccttatcactagcatattctttagctagttctagtgggaaaccataagtatcgaacaaacgaaaggcatcaaatccagaaattgtgtcggagcccttagtcttagtttcatcaataattgtatttaaaagttctagtccgtctgtaagtgtttcgctaaaacgatcttcttcagatttaataactttggcaatataatcctgatcagccaacacttctggatagtaatccttcataatttcgcctacaactggaaccatcttgtaaaggaaggtttcatttacccccagttgtttaccatgcataaccgcacgacgtaataagcgacgaataacgtatccacgtccctcattagaaggaatagctccatcaccaatagcaaacgtaatagcccgtgcatggtcagcaattaccttaaatgagatatcactttctttattttctccatactttttaccactaagtttttcaacttcatggataattggtaagaataaatctgtttcaaagttagtgggagcatcttggaaaacagaaacaactcgttctaatcccatccccgtatcaatatttttatgtggaagtggttcataagttccatctggcttatggttaaattgtgaaaatacaatattccaaatttcaagccagcgttcattttctccaccaggataattctctggatcgtcatcttcaagattattaaatgcttcaccgcgatcatagaaaatttctgaatcaggaccactaggaccctcaccgatatcccagaaattgtcttccacttccacaatatggctaggatcaattggtgtttctaaccatatttttttagcttcttcatccttaggatagacggtaacatacaatttttctgggtccatgccataccattctttggacgttagcaattcccaagcccaatgaatagcttcttctttaaaataatctcctactgaaaagttacccaacatttcaaacaaagtatggtgacgagccgtatgacccacattttcaatatcatttgttcgaatacttttttgtgaacttgttagacgaggtacttcaggaaccacacttccatcaaagtactttttcatggtagcaaccccagaattaatccataacaaagttggatcatcttgcggtactaatgaggcactgggttcaatgatgtgacctttactcttgaaaaaatctaaatacattcgacgaatttcactacttgactttctttccattatttcctcctaaaataaaaaacaccattgcatgtaaaataataaagacgcgactgcgcggtaccactttacttgcaacgatgtttaatcgtatacctcttaagtctcattaacgctgagaaaacgattcattaacttgagtagcatagaagcttcccttcacccttcacaccagccagaatgtctcttgcactaaggggttagctcctacatatctcaaatgattttaaaaatattacagctaattatagaaaatcaactttaaaatgtcaatttatcttcgcttatttcgtgattgttttatcttagcctttttggcttcacgaactgcttgatgttgttccatacgacgatcacgaatttctttttctgaaattgctttgcgaattcgacgcttgtaacctggtttaacctttttcttctttttcttaaccatcccaatcatggttgggtcaagcttcttttgactcagacgacgcgtctgacgacgatcacgatcgtacgtatcaactaattcgttgtttcgaatctgttgaggtaagaatgtaattcccatcttttcgacatcagctactttgtcttcttcgtttggcatatataaggtgattgcggttcctgacataccatttcgaccagtacgacccactcgatggataaagaattcaaggtctgtcggaatatcatcattaattactagtgaaactccatcaatatcgattccacgagcagccaaatcagttgctacaacgtattgataacgaagacgatgaatatccttcataattcgtttacgttcacgtggttggataccaccatgaattttagtaacatcgagtccctgagctttaagataatcggtcaactcatcagcacgttccttagtgttggtgaaaactaaagctagatagggctctcccatagtcaataatttataaattaaattatttttgccagaactcttagttgaaatcaagatattcttgatggtagggctaatagttgtttcggtaggaatctcttcaattaccggatgatccatatacttcttcaaaaatacatttagccgttgtggaatggtagctgagaaaaccaaaatttgcagcttagatggcattgcagcagcaatttgatctaccgcgtttaaaaatcccatatctaaggtcatatcagcttcgtcaataaccatatacttcacttgacggaagttcaaggcccgttcctttaacaagtccaaaactcgtcctggtgtaccaatgatgatagctggttgatgatgtcctaatttttcaacttgacgtttcttatcagttccaccaacgtaattgccaatttcaatcttaacttctgaagctgaggctaattgcttagcatcttcataaatttgataagccaattcacgactaggtgtcgtaattactgcttgaattgcatttaattctggatcgatattgttaaaaattggtaaaagaaaagcatgggttttaccactccccgtttgagattgtccgacaacactctttccatcagcaataagtggaatcactttatcctgtacaggggtaggtgtcttaaaattaatctcatctaaagccgtcattaaaaatggttttagattaaacttctgaaattcgttcattaaatactccttgtctaaaccaattgatctaattcacttacaatttggttaacttcttcaatgttagctgccttcgcaccactagctaatggatgaccaccgccgtcgtgtttctttgcaagttcgttgatcactggaccctttgaacgaagtcgaacacggtaagagtgatcatcttgttcaacaaaaattgcccagcatttaaccgttgtaatatgacctggtagtgaaacaattccagctgttccagcgtccttcaaatcaaacttatccaaagcttctttacttaaaacaatatgggcagccccattagccttaatttgaaggttgtcatatacgtatgatgataaatgagctactgattctggtatttcgtctaacgtctgattaacagctaccatgtcaaagccagtttccattaaaccagctactacactatgcgtatgtgcactagtagctgcatacataaagcgtccagtatctcccacgattcccgcatagagatctctagccgcgtctgctgtcagcgttaattggtccttgaagcgattatagaaatcaaaaactaattctgaactacttgatgcttcttcttttacccacatcaaatcgccaaatgggtcatcattcggatgatgatcgattttaattaggaacgccccgttctcaaagcgacgatcgtcaattcttggtgaattggccgtatcaatcacaattaccaatgcatcatcgaagaaatcaccttcaatttcatccatgttacccaaccaactcaaaccatcgatttgttttccaaccactttgatttgtttatggggaaaagatgcttgtaaaattttggcgagtccaacttgtgatccaatggcatcgggatcgggacgttgatgacgatgaataataattcggttatattttttgatttgttctaaaattttttcaagtgtgtccattacagcctcatttatcctactcattaaatttttatcaatataagtttaatactttattattagcgctcttaagcatatcacaaaatcactctgagtgcttaaacagtggtaaagaaacttcttgaaaattttgatccgttaagttggttagtgtaatccctaataagcgaatcccccgcgaaatatcagcaatttcatccaaaatctgtttagcataaaaataataggtttcaacatcattttggaaaaattcgtccaatgtgattcgtttagttaacgtttcaaaatcaccatatcttagtttcaatacaatggttttgccgtgtttctgtcttttcaaaactgcgcgaagtagattcttagcaattacccgaagtcgctcttcaacctccatctcagtggtgagcaattttccatacgtttcttcttttccaattgattttctctcacgcaagtattcgactgggcgatcatcttgcccgcgaacccaacgaaacaaggtgtacccaaattttccaaagtaatgaattaaatcattttcagacatcttgattaaatccgcaccttgaaaaacacctagctcgtgcattttaggcactgtttttttgccaacccctctaaaccgttcgattggaatattctttagaaactcagcaacgtcatccttttcgatgattgccacacctactggcttggaatattcggaagccattttagccagaaatttattgtatgaaattcccgtagagcaggttaattgggtttcattaaagataactttctgaatttcatgagcaatcaacacagcgtcaccaagcccctttttatcttctgaaacatctaaataggcctcatcaaaggcaacgggttcaatcttatcggtatactcgtgaaaaatttgatgaatttgttccgaaactgcacgatatttagtgaagtccggatctttaaaaatcgcctctggacaaagttctaaagctttcatagccggcatcgcagaatggacaccaaattgccgtgcaatatagtttgccgttgtgacaaccccatgtcctccagtaaggcgcggatcatgagctaccaccaaaggctgggttttaaacttggggttatctcgcatctcaattgaagcataaaaggcgtccatatcaacatgaattatcttacgagaatcatcaatgttgatcggagttaaaacttctgtttccattattagctgcgtggattaaaaacccatttacgtccatcatcagctagaagttgcatagctgcttcaggtcccatactaccacttacatagtttggaaatgcgggttcttcttcatcccaagcctcgcggactacatccataatcttccatgcttggctaacttcatgccaatgtgcaaaattagtcttatttcccattaaagcatcgcgaatcaagccttcgtaagcatctggaatttgagccttttcagtggctgtcttacgataacgtaaatgaactggggaaagattgtaaccttggtttccagtctttgtattaaattctagtgtaaacccttgatcaggttcaatatgcatagtcaaaacattggtctttaatttttctgacgcgtctttagcaaaaatgttttgatcatcatttttaaatacaatgttaatctgagttgattttttagttaatcgtttcccagtacgaatataaactggtacaccatctaatgacggattatgtgtaattaatttaccggcaacgaaagtttcaacagttgattgattatccgtaccttcttcatctcggtatccaagttgtgtattagcctcatctgcaccatattggccacgaatgaaatattttttagcttcttctttggtatacatttggatattttccaaagcttcaattttcttgtcacgtaaatgttctgaatcaaaaacatctggccgttccattgtaagtaacgaaacaatttgcataatatgattttggaccatatcccgcattgccccagctgtttcatagtatccagcccgttcttcgacaccaagtgattcagatagggtaatctgaatgttatcaatatgttctttattccaaagcgagttgaacaatgcattcccaaaccgtaatccagcaattgactggatcggttccttacctaaataatgatcaattctaaaaatctgttcttctttaaaggaacccgaaattgaatcgttcaattctttagcgctgggataatcacgtccgaagggtttttcgataattaatcggttaaaaccatttccctttgtaagtaaagcttgatctttcagatggccagcaattgttccaaagaatcttggtgccattgctaaataaaaaatacgatttccttgaagatcatacttttcatccaattcatctgctaatttacgtaaagctacataatgatcgacatcatcaacattatgtgattgatagtagaaatgacttgcaaatttgcgaggtaggtcatcgttagtccgaccagaatcacggcctgcgtcttcaattgcactcataactacttcatggtagtgatcgttagaccacggacggcgtgctgtaccaattacagcaaaatcctcttttaaatatcctttttcgtataaattaaataacgccggatataattttcgataagctaagtcgcctgttccgccaaaaataataaataaagccttttgattcatttttataaccccgctttcgcttttcaatagattaattatctaccattttaaaacttcaaacaagaaaaaaaagacccacgaattaaaattcgcggtctaagtttgaaaaattattcttctttttcagttgtttcttcaggttcggcttcctttacgggagcttcttctttagtttcagttgtttcagttgtcgtaagagccttcttttcgacccgcatgattgccatacgatcaaaaactaggtaaataccatcacaatctaaagtaacagttttttcctcttcattaattgaatcaaccaccccatgaagacgaccaattgttacaacattgtctccaacgttcaattgattcatcatttcttggcgcttttgttgttgtttacgttgtggtctgatcatcatgaagtacatcaatccaatgattaaaacaaagaaaatgattgaactcattccgaaaccaccatttgcagctgctaataacattttttcacctcactaaagtcgtctaagtatactgtaccaaaaatacgttttctaaaccagtactcttagaaattcttactattttccttattatatccgtattcttcaaagaaggtttgtctaaactcaagtaaattatcatccataatagcttgacgcacatctttcatcaaatgaactaagaaatagacattatgaatactggttagtcgaagaccaaaagtttcgtcggtcttaattagatggcgaatataggcccgagtgtagttgcgacaagtatagcattgacaattatcatcaattggtgtgaaatcacgcgcgtatttagcatttttaactactaaacgaccatgactcgtcatacaggtaccatttcgggcaatgcgggttggtaatacacaatcaaacatatctaccccacgaagaacaccatcaatcaaagcatctggcgaacctactcccattaaataacggggcttattttcgggaatcaattgcgttgtgaaatccaacacccgattcatttcttctttagactctcctactgaaagtcctccgattgaatatccagggaaatccatactaactaaatctttagcactttgtcttcttaaatcttcgaaaccggcaccttgaataatcccaaaaaggccttgggtttctgggttacgatgagctttcaaaccacgttcggcccaacggctagttctttcgaccgaatgtttaacatagtcataactctcaaaataaggcgggcattcatcgaaactcatcatgatatctggacccagatcattttcaatttgaatagccttttccggtgaaaggaacatgtttgctccgttaagctcgtttttaaagtgcaccccttcttcagtgatatcccgtaatttcgctaaagaaaatacctgaaatccacctgaatcagttaagattccctttttccagttcataaattggtgaagaccaccaccttctttaacaatatcttcacctggtcgcacccataaatgataggtattcgacaaaataatgtctgctcctaagtcttctagttcttcaggtgacatggctttgacggttgcttgagttccaacgggcataaaaatcggtgttggaaaagtaccatgcggggtgattatttcacctagacgtgctcctgtatgcttatcggttttaattaatcggtatttaattgcaggttccaatgtatttctccattcatagttctttatttaataaacattgcgtcaccaaagctaaagaaacgatatttttcttcaatcgcatgttggtaagcatttaaaatattttctcttcccgtaaaggccgctactagcattaccaaagttgattttggtaaatggaaattagttataaaagcgtcaaccactttccattcataacctggtttaataaaaatatccgtccaaccactatcagctttaatttctccattaaacttagagccaattgtttcaagcgtccgaattgaagttgttcccgtagccacaattcttccaccctgcttcttcacttcattcaaggctgccgctgattcttcagaaagttgataaaactcactgtgcatcttgtgatcttcaatattatcttcatccacaggtcggaaagttcctagtccaacatgcaatgtcaaataaactaatttaatgcccttttgttcaaccttttctagtagttctttagtccagtgtaatccagccgttggagctgctgctgaacctggttctttagaataaacggtctgataacgttctggatcatctaatttttctttgatgtatggaggtaacggcatttctcctagcttttccaaaacttccatgaaaattccatcataatcaaagacaatctcacgtccaccatgttctaattctttggtgactgtcgctgtcaaagcaccatccccaaatataattttggttccagtttttgctcgtttagcaggtttaacgagcgtttcccagcggtcgccttcaatattgtgtaatagtagaacttcaaagtgaccacccgttttatccttaattccgtaaatacgagccggcattactcgtgaattattcataacgactgcatcaccaggatttaattggtcgataatatcgtaaaaatgtttatcttccattgctcctgtttcgtggtctaacacaagtaaacgagattcatcgcgttctttaattggagtttgggcaattaattcatgtggtaagtcataattaaaatcttcagtagttagtgtcattttcaattcctcatttattcatatattgatcaattaagcctagatgttcgtaggcacgttctgtaaccatccggcctcgaggcgtccttttcaggaatccaatttgaagcaagtatggttcatacatttctgaaatagtatctggttcttcaccgatattagctgcaatggtggaaattcctaccggaccacctccatagagctcgatcatagtagttagaacttttttatcagtccgatctagtccacgattatctacttgaagtaatttcaaggactgactaaccaattggcgatcaatttgtccatcattttctacttcagcaaaatctcggattcgttttaacagacgattcgaaattcgcggtgttcctcgtgagcgactagcaatttcgtacgccccttgatcgtcaatatgcgagttaaaaatacccgcagagcgtcgaacaatgttagctaaatccgcttcattatagtaattcatatgttcaacaattccaaagcggtctcgtaatggagctgagagtaagcccgctctagtagtcgctccaatcaaagtgaaaggtggtaaaggaaaatgaattggatgtgcagttggtccttgtccgacaacaatatcaacaaagaaatcttccatggctgaatagagcatttcctccaccactttaggtaatcgatgaatttcatcaataaataaaacgtcaccaggttgtagctcattcaaaagagctactaaatcacccggtttttcaatggctggtccactagtcgttcgaatctgaacgttcatttcattagcaataactatcgctaaagtcgttttccctagtccaggggggccatataaaagaacatgatctagtgcttcttcgcgatttttggctgcggcaatatatacttcaagctcatgtttaatctgatcctgaccaatatattgatgcaatgtttgaggccttaacgacaactcttcattttcttcgtctggactttgaacttccgcagaagtaatccgttcatcttccatcaacttgtcttatcctttcatcaataattttaatcccgaactaatatactgatcagttgtccgatcagtttgttcactcaatttcttagttaatttcttaacctctttttcagaataacctaatgcaatcaaagcttctagagcttcatctagagcttggtttgaagtagttgataaatcaaaaagggttcctacttcattttcaaccgccactttgcccttcaaatctagaatgatttgttgagcagccttaggaccaatcttagggaactttttgagataacttacatcatcattattaatcgcattaatcaaccctgtatgatcatcgttcgctaaaatagccaacgcacttttcgggccaatccccttaacttttaataaattaagaaaaagttctttatcttcagcttttttaaatccatataaagtttgatcattttctgaaacagcttgatgaacaaaaactttctgtttagcatctagttcaaaactatatggattagccacgttaactaaaaatccaactccgttgacatcaacaacaatataagctggattaacgttaacgacgactccatctaaatattcatacatttataaatcctcatttcaaaacgtttgttcgcattcagttaattgtatcacatctcatcttccaccaagtcagaatggtgtggatcttgaattcttttaaacattttctccatgtctgtcgttgaaaaatgtactagtactggacgaccatgaggacaattaaatggattttcagccttagcgatgtcttttaataattgtttagcttgtggttcatctaaatgatgattggctttaatagctcgtttacaactcatcatgatggcggttgcttccctaaatttagctaccgtcattgagctatcatttaaaacataatcaaccatttctttaacggtgtcttcctcttgcccttttttgaaccacgttggatgatgtctaacgataaacgtatttttcccgaattcttctaaaaacaatccacacgactctaagactgtttgcttttctttaattcggatagcatccgtagttgaataatctaagtaaattggcactagtaagtcctgctgatcatcactgacctctccaatttgaactcgataatattcataattaatacgttcctgcgctgcatgttgatcaataatgtagagaccatcctcagcttcggcaaacaaatatgttccgtgcatttgtccaatgtaagtcaaagttggaaaacgttgtacggcatctttctcttttaattcaggctgatccccgtcttcaaccgcattgttaactactgcatcgttagcgtatttggttttaaattcggcaatggtatcagattttaaatcttggcgactattaataacaattggttcaggttccacatatcgatccgagatatttacttctttttcaacttcgtcgttatctgtatctggaatcgttacatgatcctgttccatcccaaaagaacccgatatggccatccgagctaagtcaagttgttcacttgaacttacttttacacgtgacttttttaaattgtctactgcatccggaatcaaatttttatctgcaagttcattaaaaacggctttggaaattaaatctaacagtgtctgttcttcactgatgcgcacttcttgtttagttggatgcacatttacatctactaaaattggatcagttttaatattcaaaactgctactggataacgaccaaccattaattttgaaccataaccatcaataatagccttactgatttggaaatttttgatataccgtccattaactagaaccgtgatatagctgcgatttgccctagtgaattctggtaaactaatataaccatcaatcgtaaagtcaatattttgttctttaacatgtaccattttttgagcatttttggcaccataaatgttagctaaaacttgttgaatatttccgtttcctgaggttcgcattagctcacgctcattattttgtagtgagatagctacttctgggtaacttagtgcaattcgattgacaatatccgtaattttagataattccgtttggagcgattttaagtactttaaacgtgctggagtattgaaaaatagatcccgtacagtaatatccgtaccttggcgactttgagcatcaccgctatcttctaatttgccaccccggtaatgaatctttttacccggtccatcagttgtagctgtcaacatttcaacatctgcaattgaagcaatactaggtagggcttcccctcgaaaacccaaagtccccaccttaaataagtctgaacgcgacgaaatcttactcgtagcatgtcgtttaaaagcaatctcaacttgatctgcatcaattccactaccattatcaataattcgaatcatctttaacccagactcttcaagcaaaatatcaattcgagaactaccagcatcgatagcattttcaactaattctttaaccactgaagctggacgttcaacaacttcacccgctgcaatctgatccgctaaaatttcacttaactcatgtatttctgccaaaaataatcgcctcacttacgaagtttcttttgccatttatataactgattcataacttccatgggagtcatatccattaaatttaactgttccagttggttagcaacttcttctttaggacttgatttaaccggcttagtaggtgtttcaaacaaagccatttgttcttcaatcatggttggcgtttgctctgattcaaccggagttgctttggagactggtgtctcaaccccatcagaatgagcttgatctttagcctcaagtttttctaaaatgacggatgcacgttttaaaagtttatcaggcatccctgctagcttagcaacatggattccgtatgatttatcagcagggccgtcttccattttatgaagaaagacaagattaccattttgttccactgctccaacatggacattcttgagatgttctagtgattgatcgagctcagttaactcgtgatagtgagtcgaaaaaagcgttttagcatggacattttgatgaataaattcaatgatagattgagctaaagccattccatcataagtggctgtaccacgaccaatttcatcaaaaagaactaaactattactggttccatccttcaaagctcggtttgcttcttgcatttcaaccataaaagtactctgtccggaaattaggtcatctgcagcaccaattcgagtaaatatttgatcaaaaattggcaaagttgcttcgctagcagctacaaaacatcccatctgagccataattacagttaaggcaagttgccgcatataggtacttttacccgacatattgggtcccgtaattaagagaatgtctgtattatcatccatatcaatatcatttggaacgtaactctgatgtcccatcactttttcgacaacgggatgccggccatctttaatttcgattgcatgatttttggtcatagttggtttaacaaactgatatttttcactaaccaccgcaaagctctgtaggacatctaattcggccacttgtttagctaaatcttgtaatctttcaatttgctttttgattaattcccgaatttctttaaataattggtattccaaatccgtagatttttgttcagcttccagaataatccgttctttttcctttaattctggcgtaatgaatcgctctgcatttgttaaagtctgttttctttcataacgtccttcaggaatattagctaaattggctctggttacctcgatatagtaaccaaaaactttgttataaccaatcttcaatgtcttaattcccgttgtcgctctttcttgtgcctgtaaatccgcaatccattttttaccattacgcattgcatctcggtactcatctaacttagcatggtaaccatctttaataatatctccatctgtaacagaaattggtgcatcttcatcaatagcattttggattagctcggcaatatcactaaccggatccaaatgttctaaagcatcatcaaagaccggctcactaagttcctctaaaatatgacgtaccttaggaatttgaagtaatgatgttttgagttggattaaatctcgtccattcacgctaccgaatgcaacgcgaccagctagccgttccaaatcataaacttttgttaactcttcttgtaaattactacgctcaaaaaaatgatctactaaaacctgaactcgatcttggcgactaataatttcttttttgcggattaagggacgatctaaccattgtttcagtaaacgtccccccatcgccgttttagtctcgtccaacaaccatagtaatgttccttgtttttttcctgtacgaattaaacgagttagttccaaattatacttggaagcatggtccattctcaaaaagaaagatggttcgtatgccactgctttttgaatatgagctaaattacgtttctgcgtagtttgcacatacgtaagtagttgcttaacaacttctatttccgttgaacttgttagatcttgaattaaatagcttaattcggcggagatttccacttcactttgcttagacactaaaatatttaactctttaaaacgttcttcaaaactttctgcaaggctttcgtcagttactatttctttggtctgtaatcctactgcttcattaatcacgctatcaaaatcatctaaaatcgcaacttttaattcaccagttgaaagatctgtatacgcaaagccatattttttagttttagaatcaaaattaacagcggtcaaatagttattttctttggcatcctcagcactcttatcagttgttgtacctggagtaaccaattggataacttcacgtttaaccattcctttagcagtccgtggatcttccatctgttcacaaattgccactttgtatccttggtcgacaaggatatcaatataattttgtgctgcatgatgaggaactccacacattggaatcggatcatctgcgtttttagaacgcgctgttagcgttaattccaatagctgggagcctttgaccgcatcatcataaaataattcataaaaatcaccaattcgatagaataggaaagcatcggggtattgatttttaatttccatatactgacgcatcattggcgtatcacttgttttttgtggcattcttttttccttccagctttttctctcatatttttaaatacgtaaaaaatacattaacaatggatattctaacatataacaaaaaaagagcggaccgctagtccaactctcctttacttagcataatcaactgctcgaacttcacgtacaaccgttactttaacttttccagcatattcgagctctttttcaatcgccttacgaatattgtgagtcaacataactgccttcaaatcgttaatcttattaggtttaacgataacgcgaacttcacgtccagcttgaattgcgtaacttttctttactccatcaaaattattagaaatctgttctagtttttctaaacgatgaatataactttgtagtgtatcactccgtgctcctggtcgtgctgctgaaatcgagttagctgcagcaaccaatacggagataacatgctgtgcttcaacaccatcgtgatgagcggcaattgcattaattaccgttgcactttctttatacttcttagccaactcaactccaagttgagcgtgcgaagtatcagtttcatgttgtactgctttaccaatatcgtgtaataatcctgcgcgttttgctacagtaacatcttcacctaattcagcagctaaaacacctgctaaattagcaacttcaattgaatggtttaaaacattttgaccataactcgtccgatattttaattgtccaattaacttaattagttccgggttcatagaatgaattcccaaatcaaagaccgcttgttcaccagtcttacgaatattgtcatccatttcttttttagctttttcaaccatttcctcaattcgagcaggatgaatccgaccatcttgaatcagtttgtctaaggcaattcgagcaatttcgcgacgaattgggtcaaagctactcaataccacggcttcaggagtgtcatcaatgatcaagtctactcccgtgacattttggaagtttcgaatattacggccttcacgtccgataattctacccttcatatcgtcattaggcaacgaaaccaccgtaattgtggtttcagatgccatatcagccgcactgcgttgaatagcttcagcgataagttttctggcagtctgatctgcttctgcttcagcgtcttcaagaccttccttgattattaacgctctttccttttccaacttagcttctgtttcggaaataattaagttctttgcatcttcttgagttagattagaaactcgctcaagttcttgttgtcgttcttcaacgagtgatgatgctttttgttgttgctcatcgatatgcttttggtctagagcaagtttctgttcttttcgttctaggctattctctctcttttcgaaggaattatccttacgatcaagagaatcttctctctgaagtaaacgatcttcttgcttttgaagctcagcccgtcgctcttttaattctttttccaccttcgcccgatagcgatgactctcgtccttggcttctagaagcttttcacgacgttccgtttctgcttgctttcttgcattttcaacaattacatctgccgaattactggcatttgcagtttgcttttcaatgagccgtttgtgcataaagaatcctgcacaatagccaacaactatagcgatgattgcgaggataatatataaaattatcatctttgcctccaaatcatcaagaccatagttatatctcttgaatgatgttatttgattttcacacttattatcattttaatatttaggtataagagtgtcaatgaatcatttagtttgaaacctatcaaaaaagattcaagaaaagtttcttgaatcttttagtagtatttaagctaaatctgaatcatcagttgaagattttttggaactttcttttttaacttcactcgtaggatcagctaccataccatacgcttcacgaactttaccaagaatttctgcacgaacgtctggatgttcatcaatgtacttcttagcattctcacgaccctgtccaatgcgttcgtctccgtatgaataccatgaaccactcttaccaaccaaatctttttcaacagccatatcaatcatctcaccagtttgcgaaattccatgaccatacataatatcgacttcagcctttttgaatggaggagcaaccttattttttaccactttaatacgaacacggttaccaataacgtcggcaccatctttaatttgttctgcacggcgtacttctaaacggattgttgcatagaattttaaagcccgtccaccaggggttgtttctggattaccaaacataattccgactttttcacgtatttggttaatgaataacgcaatcgtcttagttttgttaatcgaaccagataatttacgaagtgcttgtgacatcatccgagcttggaggccaacatgagcatcccccatctctccatcaatttcagcacgtggaactaaggctgcaacggaatcaataacgaccaagtcaatagcaccacttgataccaaagcatcggcaatagctaatccttcttcaccagtgtctggttgtgaaagtaagagtgaatcgatatcaacgcccaaattagttgcatatgcaggatccatcgcgttttcagcatcaatatatgcagcagttcccccacgtttttgcacttcagcaactgcatgtaaagctacagttgtcttaccagaactttcaggcccataaatttcgacgattcttcccttaggaaaaccgccaactcctagtgcatcgtctaatgctaaagaaccactgggaatcgttgaaatttgcgtatcaaccgcatcccccattcgcataatagatcctttaccaaagtttttttcaatttttttaagtgctttatttaaagcttcttgtctttcgtctgccaattaataacctcctagggtttctctatactagtatgatacatagttattttataaaaatcaacaaaaaagcgaacaaaagttcgaatgttttatttaataacattttcccatatcattctaaatccgttcatcacggctaggtgccgaatcttttcacggttaccaacaaaattaaattctttagtgactattgacccatcacgtttagctaaaccaatccatacgtttccgggttggtgatgttctaaggcccctggtccagctactccagtaaaactaaccgctatatccgtatctaacgtcttttgagcccctctagccatctcttccgctacttgccgacttacaaccgtgttttcttcaatcgtcgctggttgaacccctatcaacttacttttgacctcatcagcatatgttacaaatcctcccggaaaaatggttgctgctccagaagtttctacaaccgtactttcaaaagctccccccgtcaaactttctgccgctgttaatgaaatattgcgtttaatcaattgattaacgacaaaatcggtgaaagaaactctgtcaccttctgcataaaagaattctccaactcgatctagtagttgctttttagtatgatttaaaatttcctcagcagctagcttagaattagctttggcagtcaatcgaattgtcacatcggttggtttaaagtaaagggcgatagtaggattgctttgattacgaacaatctcatctactcgagcagctaaatctgcctcaccgattccaacaaaatgcagagttttagattgaattgttttctccaaaccatattgctggcttagtagcggaagtaccttttcatccaccataggttcgaattccgaaggcggtccaggcaaaacaatataatcggtttgctctgtgtgataaaaaatacccagggctaatccattaggattatgaattggtttagccccatccagtaataaagcctgacgttcattatttttagttaatggccgattttgttttttaaaatagtctgtaatttgttgtagcacctcgggatcgtgttttaagttttttccgacaaatttagccaaggattgcttagtgatatcgtcctctgttggacctaatccgccgatcgtaaccactaaatcacttctcttcgaagcgacttctaaggcatccatgatgtttttttcgttatctccaacagttattttgttgaaaacatcaatccctaatttagcaaaaagctggctcagataaacggcgttagtatcgacgatttctcctaacaaaatttctgtaccaactgaaataatttcagcgttcattttttttcctcctcaatgcttatatatgtaattttactcgtttttatttttttgtattaaaaaaaggtccataacaaaatcataaatttcgctatagtcctttatattactagaatgaatcagaaaaaatggcccgattcttataaaaataatcgattcctgaataaacagtaaagaataagcagacatataataatactgtacctagaccgaaatgtaagaaacttgagaaaatgttattcaaaagcaagaaaataatcgcgaacatttgcgagaatgttttgatttttccaggcatttcagctgctagcacctcaccatcattttccacaatgattaagcgcaatccactaatagctaactcacgacaaacgatgatagcggcaatccaagctggaaccatcttcatttctactaagacaataaaagcagtcattactaacattttatctgcaattggatcagcaaatttaccaaaattggtaactaaatgttgacgtctagcaatctgtccatctaaaaaatcggtaatagatgcaattgcaaaaacaagtgccccccaaatcttggtaactgcaatacttgttcccaaccaaactacacttccaccaacttctggcatgactgtaagtatgataaaaattggaattaaaattattctaaaaatagttaatttattaggtaaattcattgatactccctcttattttacttcaattgttatatttcgaaccaccgaattggtagttgatttaggtatttcttttccggcaatcgttcccgtaaacccagttgaggcgccaattttaagcgcataagtgtaaccttttttcaattcaattgttttgctagcgtttgcttctagcagtccttgccaagtagtttctgctttaggctgagttaccgtcaatgcattccaagatctttgacccatctgcatctttaagttagcatgctggcttcctgcagccaacgttacctctaaattatcggagctattgttaatttttttaagtgtagccttcgagttctttgaactagcactttccttcttggaagagcttgccttcgactgaccatgtttcttggtagatgtccctttagttgtatcaaccaccttgacctgatttggtaccttgaacgtagatttagtatgtccagccatgtcattgaaagctccccaaactaaaagccaaataacaaccaccaatacaattcccatcaaccatggatgttgccggattaatccttgcaaaactgattttcgttgttgtgcttctttttgactacgacttgatatctcagcatgcgcacgacgccattctttgatactattcggttcactttttaggttgtgactgccaaggtcaatttcaagtagattggcgtattgcttgatcagtgattgtgtataataatcacctggtaaatcatcattttcaccagcttctaacgccattaaatatcgttttgaaatttgcagtttaaattgaacttcttcaatcgtccaccctttttttatacgagcatcttgcagacgctcaccaatttccttgtattttctagtgctcataagtataccgcccaacttatttctaaatcaaagataagtatatcattattttttccatccaccatcaacataaatcgtttgaccagttaggtaagaggcccgttcatccataattgattgaactatatgactgatctctgatggatcaccgaaacgtcccaccggtatttcttcattaactgcttcaatttctgtttgattaaattcatcgttcatcttagtggcaactgcccctggtgcaacagcattaacagtaactcctagtgaagcaacttctttagagtaggcatttacaaaactactaatcccccccttaatagcactataaggtacctccattgaactgcctactgctccatagattgaaccaataaaaacaattcttccattttcagcgttgcttatttttttaattaccttttgaataactaacatgggtgtttttaactgttcttgccacaaattttccaactgttgggcactaaaacaatcaaacaattgatagattgtcgttccttgagcaaaaaccacggcattcaacccaaaaatatttttgctaattttttgagcagcgtcttcgcttctgaaattcgcttgaatggttaaaaaatcttgctgaggatattctgcccgtaactcattggctaattgattagttgttgcctcattttgataataatgtaagtaaagtgaccatcccttttgagccaaatctttactaatcgctgttccgatattgccacttgctccacaaattaatgcaaatttcatttcttcgcctgctcactatccattttaaacgtactaataacaacatttttcataaaggtatcgaaagtattaattacttcgtctaaagagatatcttgataaagcattgcttcatcaaaaattgtcgtatttccatagttttcaccttcaaatgaattagcaatagcttccaaagaattcatcctagtaatacttcttccatacatttcttttttagctagctcgaaatctttgaggagcgcatccgacttcattaaaccagttgtcaaaatatcttttaaggcttgtatcaattcagtaggatggttggtgtcaccgcccaaagttaggaacaaggcttctctttcactatttaaatcgtatccaaaagtgtcgtccaaaagcccttcatcatacaattctaaatataatctagaagatgaacttaagattaaatataacgccaaatcaagcgtaataatgaatcttagacgttcaataccaggttgaggcaatgctttagcatttttaactcctaacataactttaggacgttcaaccttagtcaataatgcacgattttcgataatctcatcatcatcggattctggagtaggaatttcaaagttaacttttgcaaactcttttcgttgctgattatccttaatccattgaaggatctgatccggatctaggttcccagtaacaaataaattcatattttcgggacggtaaaatactttatgtactttgtacaacaactccggagtaattttagcaattgattccacggttccggcaatgtcgtcactaatggattgattggggaagagattctttaaaatccccatgtataattgccaatcaaaatcgtcattatacatctgaatttcttgtccaataattccttgttctttagcaactgatttctccgaaaaatatggctgttgaacaaaatctaataaaatatctaaattctcttgtaatccagtcgttgaagaaaatagataactagtcttggtatagcttgtaaatgcattggaatctgctccgttattagtgaacaattcaaatgcatcgtattccgccttttcaaaaagtttatgttctaaaaaatgtgccgtgccggcgggaatctgaattttttcaccatctaaagtgaatgctcgatccattgatccaaaatcagtagttaaaacggcgtatgtttttttaaatccagttttgggtaaaatattaacttttaaaccgttggaaagaacggttgaaaataagcattcattgaacgcttgatatacttttttattcattcaaattattctccactcaagaaatattcagctcgaattttaatttgctgagctaattgttcaatatcctttttagacactgcattaatctgggttagccattcttccgtcgaccaatgccgatttaacagataattatttaatccacgccgatgtgcggttctttgcaagtccatccccgaaagataatctgattgtagtccttttttaatgttagcaagttcgctttcagtaaagagcccattttgcatgtcttggagttgttgttgaataatttgcattgcagcatcatggttcccgccattaatacctgtctggatatttaagattccgtcatataaatctaaactcgaactagcatagtaggccaagctggctttttcgcgcacgttaacaaacaacttagattgtggtgatccgccgaataaagcattaaatacgactgccgtaaaaaagttctttccagtcatatcagccggaatattgaaagataagtttaagcgtgcttggcgtacatcttgatgttcagccttaacaatagctttctcccgtgcatcgaaatgtgtaattaaaggttttaaatcaaattggcgttcatctaattcaaaaatctttaaatcttcctcaatctcttcttgattgacgtcccctgaaacactaatatgcactaaatcatttttaagcatatccaaataagctcggtaggtttctgcattttttaggttctctaaatcttctactaatccatagcttggaataccttgtaccacggtctgaccgaaagttagtttacgtaattgttgtgcggaccaatactgcttatcttctgttgccgatttaacataatttaacatattttgcttttgacgttggaatgtttcttcatcaaattgcttaccatctgctagtggatgaacaatcacttcattcaaaaagcgaatcgcatcttgaattaagttttggtgctttatatatttatcattagcaactaccattgagaaagccacatcatgcatattaccttttttagcagcacctccaccaaagctagcgccaaacatttccgatagagcatgcgtaaaccgaacttgatctggatactttttagtacttgtatctaaaatattagcaattaaagagcgttgggctaaatctttaatcgttgcgtatttcaaaaaatgtacgtcaatgcgcacagttttaaattttttacttggtaaaactaaagtctgaatcccagactgattttgaacatccaatatgatgcctcctactttttcacatgcgattaatgttagcgaaatttcgcacacttttcaatgttaattaaagaattggtgaaatcaaacgactagccaattgacggaattttttccacgaagattgttgcttgaaatattcttcatccaattcacgcgcatcctttaaatcatttttaattgtagcgattatttgttcagccactttaggatcatacataaatgcatttgcttcaaaatttaatttaaaagaacgaatatcccaatttgctgaacctacacttgtaatcatattatcgaccacaatcgtcttagcatgcatgaacccattttgatatgaatagatacgcgcgccagcttttaacaattgttgtacataatactctgtagcccggtagacgaagggatgatcaggcatttgtggaattacaatccgcacttcgatgcctgaacgaatagcgattaacaaagcttccattagggcatcatcagggataaagtatggcgtttcaatccaaatggaatgtttagcccccataatcattttaatataaccctgtttgattttttgaacatcattctcaggtccactactaacaatctgcattggaatattattttgaacgttactttgtggaaaataatctaagctaaattgaactttttgacgcttagcggatgcattccaatccatgaaaaaacgactttgcaattgcaataccacggaaccctctaaccttaagtgcgtatcacgccagtttccaaagcgcttattacgtcctaaatattggtcaccaatgttaaaaccaccaatgtatccaaccgatccatcaatcaccacaatttttcgatgatttcgaaaattaattctaaaactataatagcctagtttagatttcataaatggcgtgacttcgccaccagcctgaattaattctttaaaaaatttttgcttggatccttttgatccaaataaatcgtacaacacccttacttggacaccttcacgcgctttttgaaccaaaattttacgtaattttttgcctaactgatcatcatagattgtaaaatattcgatattgatatggtgtttagccttttttaaatcttcaaacaagttgttaaatttttcatgaccatctgtaaaaatctttaaatcatttttagtcgttaaaattgcattatccgtgtttaaaaacatctgaaccaagtcattttcaagattggtatccaaggtcggtttgtttttaggattacgcttttgatattcagccatatcgctaattccgagtcttttttgagctttcaaatcaaatatttgcctttgatttaacttccagccaaaaaatagataaattataaacccaattccaggaagcaatagcattacaaataaccaagcccatgctgcagaaatatctcgcttttccattaatgcgatcgttaacgcgatgataatattgattaggtaaaaaacaatctcaataagaaccaaaatgatcttcctccgccattcttttctccagtgtatcaaaaagaccgaaaataactaaattttcggtcttaaggttcagattattttccaaaccacttttgattgatacgttttaattctccattggcccttaattgattaattccctgatcaattttttgtttaacttcagtgttgccttttttaattccaactgcaaattgttcactgggcatattactctttataatccgataatcacttgaattcgacatatgcttaatatagtaattagcatacacactatcaattagtaacccttggatacggttagcattcaaatcaataaacgcgttattgaaactatcatacaaaatagggtcgtggtttttaatccgattctttaaaatttggggatggtcatcaatatcttgtgcccccgatgacccactttgtgcaccaacacttttatttttcagatctgctaacttggtaatcccgctacttttctttactactataatttgttgattagttagataaggctcacttagcgtcaacgctttttgacgttcatcagtgattgttaatccattccaaatcaaatcaatcgtttgattgcgcaattcagttacgttcattgaccaatcaattgtttgaaaatcaactttaattccatattgtctaaaaactgctctagctaaatcaatatcgtatccagcaagctgcccatttttttctcgaaatcccattggtacaaaactatcatctaagccaattacgacttttttatttttttgaatagtttcccaactactaggttcggccctcgtggttttctttgaattgccacaacctcctagaactggaataattaatagtcccaaagccatcacaagaaataatttcaattcttttttcatttaatccaccggcttcactgttaaagtatcatcagcaactttatctgcaaattcaatatcatgcgtaataattacttgtgtaataccattttccttcaagtctaagattaatttactaacttcatttcgaagttcaggatctaacgctgaagttggttcatcgtagcaaagaatactagggttcatcgctaacgctcttgcaatcgctactcgctgtttttgcccaccggatagttgatatggatattgttctacaaatttagttaaatcaaggcgttcaataatgttttgcacgcgttctttagcttccgtttctttttgatgtaaaacattgattggagccagcgtgatgttatcgattactgataagttaggaaataattgaaaatcttgaaaaacaactccgattacactttcattgtctcgactttcatatggatcaaacggttgcccatctaaaagaaattcacctgaatcaattttttctaacccgctaatacaacgtaaaagggttgttttacccgctcctgaaggaccaacaatagttaatattttcccatcttgaatttttaagttcaaattattgataatagttttaccgttgaaacttttaacaacatttttaagctctaacataacctaatccctccctatttaaaatatgaatagtgtttttcgactttacgtaacaggaatgtacatatccctgtcaatattaggtacataataccgactaagataaatggaaccaaagtcacatcacgagccgctgctacatttcctgcacgtagtaagtcaccaattccaatcacataaactaatgacgaatctttaacaaggttgataacttcatttccgattgatgggagaacaattttagcgacctgaggcaaaattactttcttagttgtttgccaataggtcatctgaagtacccgtcccgcctcatattgacctttatcaacggattgtaatcctccccgaaaaatttctgcaaaataggctgcatagtttaggataaaagctagtaaagcagcttcgtagcgtggaaatacaattcccacagttggtaatccgtaaaaaataaaaattaattgcaaaagtaatggagtaccacgcattaaccacacatgcgcacttataattgcttggaatggtttaaattttgatactaaccccaacgctagaaaaacaccaagaattaatgaccccacaattgtccaacagaaaacctgtaatgtcattgatgccccacttaacaaagatggtataatttctgaaatataattaatgttaaacatcgctattccccttttcaataaataaaaaatcctcttaggcgttaaaaagcctaagaggacgagttcaatcgtggttccacccctgattcgttatttactcacataaataacctcagaaagttagttaaccttctttagtagcacaccacccaacccataaaaaaatcctcttaggccaaaagcctaagaggacgagttcaatcgcggttccacctcaagtttgttgattgctcacgcaaccaacctcagaaagttaattaacttaaatgataacggaattaccggataactctaattaattgttcaagttatcaacttacagatgtgtttcatttatggtcttgaccatgcttccactgtccacggctcgcttaacgaagattacataaactacttttctgatcattgctaaagtatacaaataatatcaattatatttaaaactttcaagtccttattacataaaacttcttgaattggttccccgtgttcttctaaatacggttttaattgggtaatatagaattacaaaaattgataaattgagaataatggttggtaaaaacgaatatccgatgaaaaatgtggtagtcacattcgccatcttaatcatttgaaaaacgatgaaaaataagatgttatacatcgccatcgcaaacatatccatccccaacactatcaagaatgttgttttaacaaaaggtcgaattccacgaataaacattactacgattggaataataaaagtatccacgccaaaaactccagtataataccaatcaaatataatcccaataacaaatgaccacaatgtgaaattaatttgagattctccttcaaaaaagatcgccattacaaaccacatcaacgttagattacaaatcatcgaatatggatattgaaataaagttgacgaaaaaatttgatttaatgaaccatctagaaaaaaagcaatcaataaaacgataggaaaaatatattttaattttgcagattgtaacatgctttcaccctaatctaacttagcaatataaacgttgttaacattgcttaatttagctgctggttcgattcgaatttcgctagctaacccataatcatcttttgaaattttagcaacttttccgacatacagtccttttggagtaactcctccaagacctgatgttgttaccggagttccaactttaaccgtctttttatccgtaatttgtcccataataatctggttagtcttcttatcgtagccagtaataataccgttaatatattctccgtcagttgcttgaacctgaatagcaaaacgattagcggattcattattatcactaatcaattcaactttacttaccgtataatcagcttctactacccgaccaactaatccgttaccggctaagacgggttgatttttctttatcccattagccgttcctttgtttaccgtaattaaatcttgccatgagctcggtgaacgggttaaaacggttgctgctgttagtgaatagtccgacatggtttcttttaggccaactaatttctttaattctttgttctcagcctttaagcttttattttcggcgttgattgaatcatttttttcaatcccttttctcaaacgtgcgttttcttcgtaggtcgaaacaaagttgttaatatcagtggtcattgtttgtacaccatgaatcggcaatgcaatcacacgactaactgtaccaaaaacgtcgttaccgactttttgaataacaggcgtcttatctttctttttcaatgtaagtgaacctgcaattaaacctaccgcaataattgcacaaatcactgttataactaattttcgattagaaaaaaacttatgcatgagccctgaaccccttaacttatctcattaaaatgacttcataaattataacatataaagattataaactaggcaataacctaaatgtttatcaatcattaaataaatcttttttctgctgcactccagtaactttgatctcctacaattaagtgatcaattaggcgaatgcccattaaatcgccgacttttttcattttcttggtgaaggctaaatcattggttgaaggctctatattaccgcttggatgattgtggattaaaacaaaactatttgcactaacccgcaatacttccaccataatttctcgaggatgaacttctgccgagttaaggccacccttaaaaacaacaatttcgcgtttaatttgatttttagtatccaaacataataccaacaggtgttcttgcggttccttttgaaatcttgaaaccatcatttgtcccaactgagcacttcctagtacttttcccagtaaatggattggttgtttttgaattcgacgtcccaattcaatacccgcctccagagctacagtagcatctggaagatttttaaaaatttttcttttttcattttgacttagtaagccgtaaccagctatgtctccaattgtatcccaaaaatgattagttagctggttaattttttgactttgtccaaaactatccaaaaaagctcgaacaagttcttcgttacttaaattttcagcaccgactttttttaattttgctttcgcttcatcttgaatttccatatacatcacctctaataaatacatacggaaattcagccggctttatttaattagctgcgggcgtacctcagaaataaaatacaaggatccggtaataataattacgtcgctaggtttagcctgacgcagaatttcttttaaagccaactgccaattcgcttgataattaatatcttttcgaatcggatcgtgcagttctgaccagtctacagcagcacgcttgattggcccattaaatctagttaacgttaactctacttgttttaaatcaactaactcggtcaacattgcctcaaatcttttgtcatctaaaatagctgctaaaataaaaactttttgttctggccaatacgcttgaatcgatttttttaatgcttggattcctggtaaattatgggccccatctaaaataattttaggccgtttttgaataatttccattcggccagcccattgagtatgttggactgcttgtcgtaattgatcatagttaatcttccaatttaattgacgactaactactaacatagtttctagagcaactgccaaattatttacttgatataaacccagtaagccactgtgaatatgatcgattcgagcgaacgtattgctgaaaaaattttccttggaatcaattttaaaatcacgtttcaaaatttttagcggtgcgtgtaactttttagcttcctcttcaatcactcgtagcgcagcctgatcttcagttccagtgattactggaacattagttttaataatgcctgctttttgaaaagcaattttaggtaatgtatcacccagaatttgcatatgatcccaaccaatattcgttattacactagcaatcggggtgaagacatttgtagaatcataccttcctccaatacctacttcaatcaaaactatatccacggggtgttttttaaaatacaaaaacatcatggctgtgacaatttcgaattctaatggtccacctaagggagtttgatctaactcgtctacgattggtttgatttcttccactaacgttagaatctcatcgtcacggatagggattccatttactgcaatccgctcattgaagcgttctaaataaggcgaagtaaatgtccctactcgttgtccagtagcctccatcattttggccaaaaaagcgatggtcgaacctttaccattggtccctgcaacatgaattccttgaattgcatcttgtggattccctaactgatctagaaaggcagtcattctttttacgatcggctcttttcgtaaccgcggccgcccgtgtataaattccaaagccgttttataatccatcactgagcccccttctagcaaaaaagaaccgcatcaaaaatcactttttgtttgcagttctttaatgttaatttaaacgttagctacttgctttcagatttaatatctgcaagacgacgtttagttgcttctaatttaccttcgtaatccgtttgttttgcacgttcagctgcaacaacttcttcaggagcattgcttacaaaacgttcattttgtaattttttaaccacccggtttacttcttgctcgtacttagcttcttctttttccagacgcgcaatttcatcttccaagtttactaattcagctagtggaatgtaaatttctccgtccgtaattaccgctgacattgaaagttttggtgcctctacatctgcccctaattcaaaattagctggatgacagaaacgatcaatataatcgcgattttcattaaagagttgcattagttttgtactatcagtcttaatcaaaagatcaaccggactagacattggggccccagcttctgaacgaatgttacgaaccgccttaatcaatccaattaagtgatccattcccgcttcagcatcttgattttctagttcagcatgtacaaccggatattctgcattcactaatgattgaccatcatgtggcatggagagccaaattttttcagtaacaaatggcatcacggggtgcaacaaacgaagtgtttgatcaagaacgtatgccaatacattttgagtattaaccttagcttgttcatcttcaccgttcaaaatttctttactcatttcgatataccagtcacagaaatcatcccaaataaaggtgtacattgcccgaccggcttcaccaaagtcataaacgtcaaagaagtgcgtaacttgttcaaccgttttattcaaacgactcaaaatccatttatcagctaatgttaattggtttaattctggaagttttggctgttcaacttgatccaaattcataattacataacgactagcattccaaatcttattgataaagttccatgccgaatccatcttatcgtaactaaagcgtaaatcttgtccagcagttgaaccattggataagaaccaacgaagcgcatcggcaccatacttatcaattacgtccattggatcaatcccattacccaaggatttactcatcttgcgtccttgctcgtcacgaattaaaccgtgaagtaacacatctttaaacggacgtttgccagtgaattctagactttggaaaatcattctagcaacccagaagaagataatgtcatatccagtaactaatgtactagttgggaaataacgtttaaaatctgctgaattctcatcaggccaacccattgttgtaaatggccataaagcacttgagaaccaagtatccaaaacatcggggtcttgttcccaattttcaatatcttgaggtgcttcttcgcccacgtaaacttctccagtttgcttgttataccaagcagggatttgatgtccccaccacaattgacgtgaaataacccaatcatgagcattctccatccattggttaaaggtatgttcaaaacgttcaggaataaagttaaccttatcgtctgttttttggttatccagcgccatttgggctaacttatccatcttaacaaaccactgggtagataatcgagattcgacttgcacacccgtccgttcagaatggcccacactatgaacaattggatcaatcttaatcatgtaatcttgttcttcaagatctttaaccatggctttccgagcttcaaagcgatccataccttcgtacttaccagcattttcattcattgaagcatcttcattcatcgtattgatgcgcttcaaatcatgacgattaccgacttggaaatcattagggtcatgagctggtgtaatttttaccatccctgtcccaaattctgggtcaacatattggtcagcgatgattggtaaatgacgtccttggagcggaagaatgacttccttaccaacgatatctttataacgttcatcactagggtgtacagcaatagcaacatccccaaacatagtttccggacgagtagttgcaatttcaatatagtttttaccgttaaattcaaactcttcatctgcaaagaagtacttaacatgataaaaagcaccttggtcatcttgatgttccacttcaatatcggataaggcagtacgagcttgtggatcccagttgataatgtattcaccacgataaattaagcctttttcataaagggtcacaaagactttcttgacagctttagaaagaccttcatctaaggtaaaacgttcacgatcataatcaagagaaagacccatcttagcccactgttgatgaattgtatcggcatattcatctttccattcccaaacttggtcaatgaacttttcacggcctaagtcataacgggaaacaccttgttctcgtagcttggcttctactttagcttgagtagcaattccagcatgatccattcctggaatccaaacagtatcatatcctagcattcgtttttggcggatcaacatatcttgtagtgtcgtatcccaggcatgtcccaaatgtaattttccagttacattgggaggcggaataacgattgaataaggcttagccttttgatctccattaggtttaaattgtccttgttcgacccatttttggtagcgtccatgttcaacgctttgggggtcgtactttgtcgacatatctacgtctttagtcattaaaatcccactttcctttccaaataaaaagcaccccgtcctaactcataggacgaagatgcttcgcggtaccacctaaattgggcgtattatgcccctctttaacattgataacgaacaatttgttcgattttctagaattaaatctagaaaattggctcataagcaacccgaactccaactttttaagactctcagcaaaaatgtctattctctgaaaaaagttttgcagctctcctcttagtcataaccttcagaataaataataaagaataattgtccgttcgtcaattatgtttttacattttattgataaaatcaagtgcagcttgatagtcaggttcgtcatgaatttctggtacaatttcacgataaataattttgccatcagcatcaacaatgaagatactacgagctagataaccagcattcggaatatatagattcatctcataaccaaatgatagctcatgatctgacaatacttccatgttcttaacaccttcatttgcgcaccaagctacttggtctttaggcatgttgttagaaatggttacaaatcgaatatctgagtattggtcagtttcttggttaaattttttagtttgcatgctgcaaaccggcgtatttaaatctggaacaacactaattaaaagtggtttacccagtaaatcgcgtgtcttaactttttcaccatcgccagtaaaaactttaaatttgggtaattgttctccaatcattggaggatttccaacgagttcaactttttctccaccgcgtaatacttccataattgtacgctcctttatttaaattacgttaaccttatctcaaacactcactgatttcaatcaatatacaaatcctttacaataattcagcaaaaacttcttcattttgattcataaagttttcttcagcacgaatgttagtaatttttacgcctgctaaagaacgttccaataatccttcaacgtcaattctcttctcaaagtaacgcgtcttttcgagatctggatgtgttttaggtgatggtggagcaaaaatcgtacaacaatcttcgaatggcataattgataagtcataagtgtcgatatccttagctatgtcaataatttcatttttatccattgaaactaccggacgaataatcggcatagtagttacgtcattaatagctaacatgctttccattgtttgcgaagctacttgtcctagagattctccattaaagattgctagtccaccacgttgtttagctagggcaactactaggcgcaacatcattcgacgttgaatcgtcatcaaataaccctctggacatttttctttaatagtttcttgaatttctgtaaatggaacttggataaattgaacacttccagaatatgcagctaattttccacttaattccttagccttagctagagcttgttcgctagtatatggcggactgaaaaaatgcaccatttccatctctacgccacgtttcatccccaaataacctgctacaggagaatcaattccaccagaaagcatcatcattcccttgccagcagttccaaccggtaagccacctgccccattaattacttcactagttaagaaaattccattagatcgaatttcaacacgtaaggtaatgtctggatttttcatttttacatcattatctgggaagttatctagtataaatccaccaagttcccgattcatggtatctgtattaatagcaaattctttatcagaacgacgtgtattaattttaaaggtcattcccggctttaattgctccttcatcatttctagagcaccagcttggacagcttccattgttttctcaacttttaacattggcgaaaaattttgaatcccaaaaacttttttaagtctgttaatgactgcatcactgtctgtaccatttaaggttacatgtgtacggtcacgattaggatgaatttcaacgtcttcaaagtccttaagacttttacgtatatttcctcccaaacgagcaataaaatctttgcggtttttacctttagttgatagttcaccgtagcgaaccattatttccgtatatttcatataaactcctagctatttttatttatttttgaaaagtcttgatataattggtcaaaaattcgattaaattcatcagcttcttccaaagaattagcactatctaagctaactcggacggcactcgttgaaatggttgagtcaatcttcattgccgttaaagtacttgaagcttgctgttttttagaagaacaagcactagtggtcgaaatgtaaattccatgtgattcaaacgcatgaacaatcgtttctccacgcacccctttaattgcaaaacacaaaatatgcggagcaaagttagcttgaattttagaaaaagcaaccactttttcaaacttagttacgtgattataaattttctctttaattgattcttgtaaagctaccttttgatcttcgccatcaagtagtaaacgcagtgccttagccatcccggcgatcgcaggtaagttctccgttccactccgtaaattcttttcctgtccaccaccagttaacaatggtgcaattcgcctaccttcgcgcgcataaataaaacccacccctcgaggagcatgaaatttatggccagagaaggttacaaaatcaacacgatcattcatgattgcagcttgaatccctttaccaattccttgaacagcatcgatatgaaaatgtacttttggatagtcctttaaaacttctgctgcttttaaaagtggttgaattgttccaatttcattattaattgccataatcgaaaccagaatcgtatccgggcgaatggcatcttttaaatcttgaatgttaattcgaccctcatcatcaacgggaagataggtaatatcaaatcctaattgtgctaactgttccatagaattttttacggcaggatgttcgacagccgtcgtaattagatgctttccatacatccgtttttccatcgctgtccctttaattacccagttgtcgccttccgttccaccacttgtaaaaaatatttcgtgaggtttaacatttaacaaactagcaatttgttttctagactgctccaataaattgaacgacatttcgcccatatcatgcaaactagaagggttaccccaaatcttattactgaccttttggtaggtctctaaaacgttcttatcaactttagttgttgcactattatcaaaataaatcatttactcatttctccattatatatttccgtaaaccctaataattataacagaaaaatatacttacaaaattaaagtaatctaaatatttagatcttcaaagtaaaatgccatcgcactaagtacgatagcattttattttctaatattcagttcgtttttgttggtagtaattgtctgtgatattatccactgcacctggttcaacttcttctagtgcttttgtaattacagttaaactttcattgtaacgatggtccgtatcaaaaagcttttgagctcgtaaaatagcatcttcgatatcttgatcggtatgacgataacgattagcgtattgaattgctaactcactgatagcggcatcgtctgtcagatcagtggtcttcttagtaagagtttgaatatccgtacttaccatatcaagttctcggttaattttgtctatattaactcgaacttgattcatatcgctcccaactttttcaatctcatcactaaccacaaagaagtaatccatgtatccttctggaatacctggaaggttaagactttcaacgtgacgtttgatgttatggagttcaccgtcatattgttgcattcttgcacgggcatctttttcactatctacaaggctttgaagttcatcatttaatttagcttgttgatcttcaatctcagaaagttggtcattttcagcttttaaacgttccacaatttctgagtaaacaaccggttggttagtaatttgttctgtatcacgatcatgttcattacgaatttcatttaattcagcatctaagttttgacctaataccaactgatcatcactcaaaacataactttgatccatgcgttccacttctgctaacaaaactttattctgtttttcagcgtgatctaagaagcgagtaattacatcaaaattatgctcaactgacttacgtgcatcaatctcagtttgtaagatactgtataaatcgtcaattctaatttcaattgacttattgttatcacgtacagcatctaaacgtaagttaccaagggtttcaagattatctgaaatcttagctttaatagcacccagctcgtcatcaacgatatcatcttcaaaggcatagttatgattaatcaattgatcgtagccatctttgatttcagcaatttgctctggaaatacattagttagttcttcatataaaggtggaacgttttgaatttgtgcttctaattgttctgtacttgttcgaagtttttggagttggccttcagccttttcatgatctccagcttctacggttccactgaacatttcaaattcatcatctaaacgagctaatttttcttctaataaatcaatgcttggaccaagcgttaggttcttagctagaagtgtttttctaatttcttcatacttcatgcgtaagaccttaaccgcatctcgttgttcttgatccgtacgtttaatattatccaactgatcgttaagacgtcgcgtttcttcgtcaattgcatctaaagattcactaaccgtcgtaacatccttacgcgcttcgaaaatcttcatatcattgacatcttgtttcgaatggttagcaatgtcttcaatttctggtaatcgatgatcaataatttcctggtagtcatttcgaatgttatctaacccaatagccgatgatccagttagattcatggaggaaacttccattagtttttgacgcaccggtgattcactgatgtctgcttttcgatctaataattcatcgatttgtttaagtaaataacgttgatatgaaacaattcctaaataaactagaattgctaccactatgattgcaatcaataccatgatcataactaaaatcccatccttcttaacttcactcaattcaattgataaaaaacttgccttttaactttcttcaatttagaatttacctaattaattatatcatacccattagtttgttaaactagggattttttattaattaaacattatataggaagtgactacaatgtcagaaccgattaactcaattattgtcgaacagattgatgcacttttgtttaatgaaaccaacttaattgccaatctttcaaatgcttcagctttgttgtatagcgaaaccaaagatgtaaactggtgtggtttttatctttttgattcaaaaaaagatgaattggtcctgggacccttccaaggaaatgtggcttgtatgcacatcaaaaacggttcgggagtttgtggaactgcctttaaagaaaataaagtcctccgtgtggaaaatgtgcatgaatttcctggacacattgcttgtgatagtgcatcaaactcagaaattgtcttacctttaatggtgggtaaccaattattaggtgttttagacattgactcaccgattctcaatcgttttagtgaagatgatgaagccactctgattaaattcagagacgcattagttaaacacattgacagttctgttttgagtgcgttaaactagtaggagtgtaaaataatgcagcggtgggcggtaagctcgtcaacagattgttgcctgtttttcaggtcaactagtaacctcagcggctgcaaaggtgaaccttgcaaagcaatctgcacgaatactaaacccacatttgtttattttactccaacaaaaacaatttattggaggatatttttatgtctagatatacaggcccaagctggaaagtttcacgtcgtcttggtatttcattaacaggtacaggtaaggaattggctcgccgtccttacgctcctggtgatcatggtcaaaataaccgtcgtaagatttctgaatacggtatgcaacttcgcgaaaagcaaaagttacgtatgatgtacggtttaacagaacgtcaattctcaaacctatttgttcgcgctggtaagatccgcgaaggtcttcctggtacaaactttatggttttacttgaacgtcgtttggacaacatggtttaccgtttaggtttggcaactactcgtcgtcaagctcgtcaattggtaaatcatggtcacatcactgttgatggtaagcgtgttgatattccttcatacgaagtagaaatcggccaagttattggcgttcgtgaaaaatcaaaagatcttaagattatcagcgaagctgttgaagctgttgttggtcgtccacaatttgttcagtttgatgctgacaagttggaaggttctcttgttcgtcttccacaacgtgatgagcttgaagcagatattgacgattcacttatcgttgaatactacaacaagctataatcatattaaaaacggccttggccgtttttttatttactttaaatttttattttaggagaaaaaatgcaaccattagcgtttcgtatgcgcccacgaactatcgaagaaattgttggtcaacagcatttggtcggtcctggaaaaattatcgaccgcatggttaaagccaaacttttatcatccatgattttatacggccctcctggaactggtaaaactagtattgccagtgctatttcaggctcaactaaatatgcttttcgaattttgaacgctgccaccgattctaaaaaagatcttcaaattgtggctgaagaagccaaaatgagtggaactgtaattctgctactagatgaaatccatcgtttagataaaactaagcaggatttcctcctcccccatttagaaaatggcaatatcattttaatcggtgcaacaactgaaaatccttatatcaatatcaatccggcaatccgtagtagaactcaaatttttgaagttaaaccacttcaaccggatgaaattaaaaaagccgtccttgctgcgattaaggattcctcccgtggcttaggtgaattacccatcgtaattgatgaagatgctttaaaatttgtatctgagtccactaatggtgatttgcgtagcgccttaaatgcagttgaactggctgcgcgttcaactggtcctgacgaaaatcaaaaaattcacttaacactagctattctagaagaatgtctgcaaaaaagagctctcacccaagataaggatggggatgctcattacgatgtaatttctgcctttcaaaaatcgattcgcggtagtgatacagatgcggctctccattatatggcacgacttttggaaagtggcgacttgcaaagtgttatccgtcggctgttaatcattgcttatgaagatatcggtttggctaaccccccagcttgtcaacggacagtttctgccgtcacggccgctgaacacgtcggactgcctgaagctcgaattcctttggctgacgccgtgattgaactttgtgtctctcctaaatccaattcaggcattaccgcaatcgataatgccttaaccgatgtacgtactggaaagattggtgaagtcccagaccatctacgcgattctcattacaaaggtgcagctgctttaggtcgtggggtagattacaaataccctcacaattatcctaacgactggatagctcagcaatatctaccagacaaattggttgatgctgcatattttgatgccaagggtaatagtacctatgaagagaaaattaaaaatcggtacgaaagtctaaagaaatcacaacgttctaatcattaacattgtattttctacaaaaagtatagtaagataattatgaagttcttaggtattcggaattatcggtttcatattcttccaacaaacatctaatcgggagcacggatctcaagtgaattgtatgccttgtacaaggaaacatgctgtttgggtatgtgcacccacctagttactagggttagatactggccgatatgaacgctactaaaagttctttgccccactccggtggggtttttttatatattaagaaagtaggatttatttatgctaattcagctctttatgttcatttttgcaattattatcttttatatcggttattacctctatacccaccgttccacggattttatgctatttaaaccttctactaataaattactcagccaaagtttaaatgtagttggaaaaatattaataggcattagtattattactctactgttaggaataactggaaatactgttctaattttaattgctttagttttaggaattttttctaccactggaactttgctatttttattaaaatttttatagcaaattcctttttattttctcatttttaacgtacaatgagggtaaatagataggagtggttatgttatgacacaacagtataaacatattcttgttccagttgatggttccaaagaagcagagctagcctttagaaaagcagttgccgtcgctaagcgtaacgatggtgcagaattgcatttactccacgttatagatactcgtgctttccaaaatatttcgagtttcgataccgccatggtcgaccaagtcacagatacagctaaaaaatctttagaccgctatatccaagaggcacacaatgatggattagaaaatgttgcttattccattgagtacggttcaccaaaggtagtaatctctcaagatgtccctaaagaacttcatacagatttaatcatgattggtgctactggattaaacgctgttgaacgtttattaatcggttccgttaccgaatacgtaacccgtaccgccatttgtgatgttttggttgttcgcacagacttagaaaataaataataaaataaagtacagcaatttagtttaaaaaattaaatcgccgtactttttatttacaccattttaacgataactacaatttacccagtgtgtattaattattccacttgcttgtaaaaagaagctaatgttagttggtcccacaaactgaaatcctagctcttgcatgtccttacacacccttctagcaattggtaaatcaaacatcattttagcattatttttgggttctaaatccatagggacaaaatctacttttgaccagataaaatcattaaaagacatccccgtttgagacatttttaagatcacatctgcgttatggataactgctttaatttttcgttggtttctaatgattaatggacatgccatcaacgcttctaatttagactgatcatagtcagcaacagtttgaactttaaactcgtcaaacatttcatttaatgcttccaatttcgtcaaaaccgttcgtaaatctaaccccgattggaaaatttgaattgccagacatttaaagagttcttggtcactaaaacatggctttccccatatcttatcatgatagttttctaaaattgcattcttagttgaccacgtacattttaatttcataaaaaacccctccttagggtttaattactctaaagagggattttaaatttatttttttaattcatcgtaaagcttttgcttgcctaatacgatactttcacaaaggtcctcataactaataccagctgcttctgcttcttgtggtaataacgatagaggtgtcattcctggaaggttattggcttcgattacatatacgcccgtgtcgttagttagaaaatcaacgcgtccatagttagtcatgcccaaggcatccattgtttggacagctacccttttcatttcatcatgaacatcatcttcgatttctggaggagtaacgaatttagtcgttgaacccgtttgaaatttatgttcataatcgtaccaaccatcatttaccacaatttcaattgctggcattgcttgaccatttaccactcctagtgaaaattcacgtccagtgataaattcttcgacaataatttcatcatcaaaacgataggcatcctttaatgattcagctagttcggcttcatcatgtacaattctagtaccaatacttgaaccaccactattaggcttaacaaccattggatagtcaaaggctaattgaggatgaataccatcttttgcatgcaatacagcaaattgggctgttttaatgttgttatacaacataatctcttttgaaattgctttatccatggcaattcctgaagctagtgaaccactacctgtatatttaatatgattaagatccaaaacagcttgaactttaccgttctcaccatcaccaccatgtaacgctagaaaaacaaagtcagcagcttggaggattggtaaaacatttttcccgaacaatccaaccgtaccgtctgtacgaagttcttcaatatcttcttctgttaaaactgcgtcactgatttcataatcagtactggtattactagacttaaatacgtcttcataactttgaccatcctcaagttcatatcccaagaataaatcaatcatcgttgcatcgtaaccttttgatcgcaaagcattggtgatctttgaaccagatgaaagcgacacgtttctttccgtgcttttcccaccggcaagtacagcaattttcattttttccacctcgtatgtaagataattacaaaccttgagtttgctccgccaattatcaaacgtttattgaaccttcagtatatcataaaatcagttcaatgatgaaatagaagttaaaaattatactgtaaaatcattggaatcttccaaatattccacaattgaattggccatatccggatttaaaacgagggcttgcaaaaaacgctgacgattaaataaagcattccacatagcactggactctctcatttgaattgtttccaaagagcgacgccattcgcgaagttcaatcaataaaaattgctgatatacgtcgtcttcatatagttggtcggcaatgtataccgctaaacgaatagattctccataaattaacggtgtttttaatctttttatcttttcaatcactgtacacattaataaaattttatccgctcggactaacttttcatcacttgctagctcatctaaaacgttacccaaatgtgtataggcatgaatccatcctcgcccgtcttcatatccacgtgtatcgttttctagcatagtatagagtacaatttggtttaccaatcttgatcgacgtttaggatcaataaaagtggtcccagctcgatcaatgtagataagagttgctaacaaaattagtgtgtatgctcttaaatatgccgcatcattctgtgtttcattaatatgcgacaagagcatctggtcactaatcaaacgatcaaatatcattattttttgatttttagttaaaatatcatattggagtaaatcaccaaaaagagtgaaaactccaccatcacggatttgagctttaaaagagcctaggtgatccattagtagattaatgttatcatcactaatttcgtccatgtctcccttccccaactgttcattaataattttaagtaattcaactacatcatcttcatcttgggggacttttacctcagtaactggtaaatcttgtgaagccgaatcaatgattagtccaactgattttcctaaagaagaaaatatttttccaactcggagatccatccttagagctgctatttttgtttgtgtttcattaattgaatccaaaggcatgtcctcctaataatatattgattctaacacgttcatcaacttagcaaaaatatttcccattcttcacttaaaaatacaattaaatttgattagctaaacattaaaaataaatgatagaatatgatatgatagtctatactactatttaaggaggttaaattattgcataatttcatcaaaaattttattaaaaaagaaaatcctgctatttatgaagacaaagattctcatttgactcgtaccctagtagtcaaagactttttagctcttggggttgggacgatcgtttccacctccatcttcacacttcctggtgtggttgcagctcaacatgctggtccagccgtcgtactttcattcttagcagcagctgtagttgccggcttagtagcctttgcttatgccgaaatggcttccgctatgccatttgctggatctgcatactcttggattaacgtaatcttaggtaaagggtttggttgggtagccggctgggctttgttagcggaatatttcatcgccgtagccttcgtggcctccggactttcagctaacttcaggggactgctttcctcaattggaatccaaattcccaaacagcttgcaaatcctctaggtactaatggtggaatcattgatattactgcgttgatcgtcgttattgcggtagcgttacttttagctcatggaactacaggagccgctcgcatcgaaaatgcactcgttgttttaaaggttgttgctattttagtatttattattgtgggactttcagctatccatattcaaaactacctaccatttatccctaaatatcataccaacccagacggaacttcctttggtggatggaaaggtatctattcgggaatttcaatgatttttctttcctatattggttttgattcaattgctgctaatgccggagaagctaaaaaccctgaaaaaactatgcctcgcggtattttaggatcgttaataattgctgttatcctttttattgcagtttcgctagtgctagttggaatgtttcattacacaaattacgctaataatgctgaacctgtcggttgggctttacgacacgctggtcacggagtaattgctggtgtgattcaagcaattgccgtaattgggatgtttacagcattaattggcatgatgatggctggttctcgtctgctatactcatttggacgtgatggtatgctacctaaatggttaggtcaagtaaatccaaaaggtcttcctaaccatgcattaagccttttaacaattatcggcattattattggttccatgtttccttttgctttcttagcgcaattaatctcagctgggaccttaatcgcctttatgtttgtatcgttagggatctatgtcctgcgacctcgtgaaggtaaagatattgctattccaagcttcaaaatgccgctctaccctgttcttcctgccttggctttcttaggctctctggcagttttctggggactagacgcccaagctaaattatactcactagtttggtttatcattggaattattgtttacactttctacggagcaagacatactacagattaaaaaacgcatctaaacttagttaaaagctaagtttagatgcgtttttgtcatccaaatatttctggaagaacttgttgaccacgctgttcaactaaatttttataaaatgcggcataaagcccgttacgatagggaacgtaccaaataaatcctattccaaacgtaatgatgcttaaaatgtaccatccaattaatgaaatttgtaatcccagtaatcttgccttattgccatccatgagtcgtcgactaaaagtaatgaaattaacaaattcaaaacgatcacttatcttccgatcagtggcttctttataaagaaaataggcttgtgaatacgaataatatttgatccaacccggaataatgagcaagaaggaccataagaagcggaaaataaattgaaaaataaaaatagctagagttgatgtaaaatactttctgctaaaggtttggaaggctgtcccccatgaaagacgctgatttcggtgtcgtaaccaatctaaaattccgtattgaattcccactgtaaaaaatactacgattgcttgaaagaaaaattgttgagcagtcgtcctacctgaataaggggtccctgaattttgactgtaatttcccattgtacctagtgcgctgctatcaatctgactaaaaaaatataaaattattccaatcaaactagcaattataaatccactaaaaatggagcaaacaattggtataatgttaattttaattgctgttatccagtttccccgatagagttctaggacttctttctttaatgttctattgcttgtctgatccatataaaagtcattctcctcgtttagtacgtaataatgtatttaaccatcttgagattatcaaagataatacaatcaatattaccatacctgtcgctggaatgattgggttaaagtaacctaaagttttagaataacccatagcaaattttaagaatgctaccaacgggtctaatatatgcgattgtcgtataactattctttccaatatcgctaataacaggattcctaaaatagggattgatattgccacaattttttgatttttccgtgttaatagcgcaaagacggctcccgcaatgataccaaagacggctagcataaccaacataatatagttaacaataaacattgaaactaaatctaatggcaatgatttaaagaaatgaccatataattctaaataaggtactgacttatacccacttcccccgtttaatgcaaacaatccggtaataaaactataaatattaccgattaacgctacaattaatatcgatataacctttgcataccaacccgttcttcgcgaaattccattttgaattaagaaagaaaaacgctcgtacgttaaaaagccaaaataaaatagtaaggctacgttaacaaacaaggctgccgttgttagtagagataaatcatttaagatggcaatgaccatcccttcggtaccactagctactaaatgtaatagcactggaattcctaccagcaaaccaattagccacaggtaaacaattaaaatcaagcggacaaaataacttaaatcgtacttgattacgctagctactttattcattctcattacctccatttgttaaattgacaaataaggtttgtaaatccatttgatcaatgttaattaagtccgaaattggtttattatctaatgaaccaaaaacataactagctttgattcgagccaatttatcgctcccaataacgttcaatccttgggtatattcatccaccttgtcctcaggtccgctaactacgtaagcttcacctagcactttttcggtttcatcatccacaattaaacgaccatgatcgattactaagacatgctcaattaaattagcaatctcttcaattagatgggttgaaataacaaaagtacgaggattttccgcatatgtctcaactaaggcattatagaaaatttctcgatgaccggcatctaaacctagaataggttcatctaagaaaacatattccaccggaaccgccaatgcaacgattaacttcataatagtacggtaaccggttgataacttattaaaaataatattagtttgtaatccaaacttctcacataaatcttgtgcgagttcttcatcaaagcccccgtaaaagctcttggtccacttgaaaacatccttaactttaaggtttttaggataaagatccacttcactcatcaaaaacatcttagagagttgttcatcattatcacgaataactttattatctaaccgaatttctcccgtatccggagcaattcggtttactaataagcttagtaaagtactttttccagccccatttcgacctaacaaaccataaattttattaggctcaattgtcatcccaattccatttaaaatcatttttttatcgaatgacttggttacctgctttacttcgatccccttcatatagatttatacccctgttcaattaatttttttaaatcttcctcattaatattaaggcgaactgcttccttaactacccctattacatacttattatagaaattttgctggcgattcaaagtaatttgattacttgccccctcagccacgaacatccctactccacgatgtttttctaaaagctttcgtgaaaccagttgattcattccttttaaaactgttgcaggatttatgtgaaattcttttgatatttcagtagtggaagggatctgttctccctctttaaaaccgccggtaaagattgcatcttcaatctgttgggcgacttggagatagattggttcgctgctattaaaattaaattgcataacatccaccttcaaattttattaattccttcattataaacttaattagtcatgtaactaactatatgggttatcgtgcaaaaagtcaattaaattgacatgtttaaccccgtcagaccaacaaaaaatctgtaataacattcagtgttattacagattttagaagttattcaaccggctctacagaacctttaaagtgttttttaatccaactttgagttgattttgacttaagtgccttaatcactttcttaagggctttattgttcttttcatctggtctaattgctacaatgttgctatatggagacaatgatttttcaactgcaatcgcatctttggcgggacttaatttagcctgaactgcataattagaattaattacttccgcgtcaccttgtttattattgtagagttgaggcatcaatttaggttcgtaccccgtcttaaatttaatattcttcttattagtggcaatatccttaaagttagcattcgtggtatccgtacccttcttgagagtaattaacccagcatctttaaagatttcaagcacccgtccataatctgctacattattgcttactagtaccgtcgcatttttaggtagatcttttagtgttttatacttctttgaataaactgcaatcggttctaggtgaattgaacctgcgctaatcaaatttcctttgttcttggcgttccattcctttaagaaaggagtgtgttggaagtagttagcatcgatatctttagaagctaatgccttgttaggtaaaacataatcttggaattgtttaattttaagatttaccccttccttttttagttcaggttgaatatgctttaagatttctgcatgaggggtaggtgaagccccaatggtaaccgtcgttgtttttttagcggtacttccacaagctgccaaaactactgcagttgctgcaattgttaatgcggttaaaactctactctttttcataaaaatttcctccttgattaaacaacccttttatcaataattttaactaataaatcaccaatccattgaagaacaaaaacaaataatacaattagaatcgttgccaccagaatgattgttccattatattgcaagaaaccattgttatacgctaaggcacctaagcctcccgcaccgatggctccagccattgctgtatatcctactaacgaaattgctgtaacagtcaagcctgataccagcgcgggtaaactttcaggtaacaaaactttaaagataattgtccaatggcttgcacccatcgcttctgctgcttctagaacgccttgatcaatttctctaaacgacatttctacaattcgtccaaaaaaaggagccgcagaaagaattagagaaggtaaagctgctactggacctacaatggtgtggactaacgtattagtaaaaggaatcaaaacaacgattaaaataatataaggaattgatcggaatacattaacaaataatgaaactaaccaattaattacctgaatcccgttactcttgctatctttggtttcaaagagtaagagacctatcaaacagccaataattgctgtaaataaaactgacacaagtgttacccaaattgtctcccaagttgcactccccatttcggcccaatcaactgaactaaaatcaaaataagaactacttcccatctgcgataacctccgtttctacccgtaatttctttaagaaattaaccgacccagctacttgtggttcaggtcctgttaattgtaaatataatgtcccaatagaaccctcttgagtttgcttaatattacctgcaacgatatttaaatcaactttgggaaattcatgtaccatttccgaaacgatcggtaatttagcctgatccccatggaaagttagccgaacgattctactattgggatatttatttaataactcatctaaaacaatttctgtttcttgatgacttggatcagattctgcggaaacaaaacgttgtgttaacggttgttgaggatttttgaagacattcagtacttctccctcttcaataatcttaccgccgtctaaaacggctacattatcacaaattttacgaatgacatgcatttcgtgggtaatcaatacaatggtgatattcagacgtttcttaatatcaagtaataaatctagtacctcatcggttgtttctggatctaaagcactagtggcttcatcagagagaagaatttctggatcatttgccaatgctcgagcaacacccactcgttgcttttgccctccggatagggaagctggatacatatcttcctttccttctaaaccaaccaaatcgattaactctaaagccttcttttcacgttcagctttagcaactccagcaatttctaatggaaacataacattttcttttacggttcttgaccataataaattaaaatgttggaatatcattccaattttatggcgttggacgcgtaaatctttagctgataattgattgattgctactccattgatattaacactcccagttgtcggcttctcaagaccatttaacattcgaattaaagtcgttttaccagcaccagaatatccgataatgccgtatatttttccactatcaatttttaaattaacatccttaattgcgtggactgttccttctttggtttcaaaagtttttgaaacgtccttaaattcaatcaattctaatcccccttttaaacaaaaaaactttcgcccgaatatagctaaagctatattcaaggacgaaagtttgtcgtgttaccaccttgttttttcgttgccttacggtcaacgaactctgcgggtcaatcaacccgtgcgctgtaatgggcgctcccatgatttgctaactaaatgctcacaaatccgctgaataaattgaaagaccatcttcaacgattacctcgatttccttccaccaaccggaaactctctaagcgtagataaatctgtttactcatctttctctaatactttgttaataggctaaagtatacatgccatcagtttagctgtcaacactaaaaataaaaaaactaggacacctaatttgtatcactagtttttagaaatcagctttttgttctaatcctgttttactataagaataataatggtacctcatcgacatgattaaccccacgccaatcatatttccgatcaatgccgaaccccctgcactaacaaacggtagcggaattccagttagtggtaaaagcccgatgttcattccaatattttcaaatacatggaatagaatcatcatgataactcccactgctatatacgcataaaattcatttttagtatcaaaaatgacttggataattttataaattaataaaaagtataacccaattaatactacactaccgacaaatccaaaattttctccaataaccgaaaaaatcatatcagattctcgaaccggaacgttaacgttcgaaacgttgaaaccttttccaaataattgcccagaaccgatagctttcatactttgccataattgataacctgaattagtagtatccgaagcaggatgcaaccaattatcgattcgagcaaattgataagattcaaaacctaacttactcaaaaacgattgtccccaacttgtagcaaccagcatcaaggttgaacttcctaataccaccattccgacaaaagacggtaccaaaattcgccaagtaactcccgaaaccacgactaatccagcaaaaatagcaataaacactaacatcgtaccaaagtcatgttgcaacaataacaagataggcactggtaaagtccataaaatcattgttccgataagcttccaatcactgcggactgtgcgctcttttacttttgagttgtaaaccgtaataacttttgccatcatcaaaatataagctggtttcattacttcagagggctggaaggtaaagggtcctagagcaaaccagctctttgctcccgtattagccgcgtaggctcgactgtatagaaataagactagaactaacaaaagtagtccaattccatacacaattggtgctagtttccacaattgtttcgaatcaaattgcattatgacagtgacaattacgatacccaatacgtaccaaactaactgagaaacaacctgtcgtaagatgcttgtagcactagtatcatgtgtcgcagctacgtagatggacgccagcccgataattgctagcattagcactggaaaaataattccatagtcaatccgggaactatcatcctttcgagcaaccctagaattcattctttccatcgaggtagctcctttctatagagaatgtaggttaaattcagctacaatccattgaattccttcatccatagattttacacgcatttctccactttggttagaagctgtaaaattcttatcatttacttgagaaatttgaccaactaactgtctgttgatataaacctcattgataactgaatcattttctttaacttctttaatttcgatttcgaactttttctctcttctagacattttaactcctaatttcttggtttactatttttttgattgcgttttaaagaaaaattatctggcactggatcgtatccgcctcgcacaaatggatgacaccttaaaattcttgcaacccccatcaagccaccttttatggcaccaaatcgtttgatggcttggaggctataattagaacaagttggataatatcgacaagatggcggaaacattggcgagataaatttttgatacccacgaataatcagtaacaaaatttgcttcatttaggtttaatcccctatttgactaaaaatgttaaattttcaatcgttgtaattaaatttaagaaaaaactacttaccgtatatccaataaccacagacagcaatacgattaaaacccgtgcttgattctcatatcttcccataaatttatgaaatggaatagcctgaatactccaaaaggaaatcaggatgaaaaatagataacaaattaaagttattacagattgaattcctaacataattttcctccaaaatttcatacatgtattattgtaccagaaactaagctaaatttatcatttttaaacacaaaaaaaacgctcaaaattgagcgttttttatgaccaataactaaattaatgttttgatacattaattcggttaatagcccgacgaagtgaaatttgagcgcgccgtaattcactattgtcgtgtgcttgttgcgctttacgaatcgttgcttcagcacgtttcttagcactttcagcacgagctacgtcgatatcagattgattttcagcggtatctgcaacaatagttgcagtattctcagaaaattcaacaaatccaccatttactgcaataacgtcttcctcttgactgtgttttacccgcacttcatcaatcgcaagagcagcaattacaggaacgtgattaggcaagatacctaattcaccttctttggtattaactaccaacatggtaacttggtcatcatcatagacttgaccatcaggagtaacaatactaactgttaatactgaattttcagccaattagatccctcctaatcttctgtagcacttatttttttagccttttcaactacatcatcaattgatccaaccaaacggaatgcttcttcaggaagatcatcatacttaccatcaaggatacccttgaatccagaaattgtgtcttcaatctttacatagtgacctggaaggccagtaaattgagcagcaacactgaagtcttgagataagaagagttggatacgacgtgcacgagcaacgacggtcttttcttcatcagataattcatccataccaaggatagagatgatatcttgcaattccttataacgttggagaacatgttgtacctctgtagctacttcataatgttcttcaccaacaatttgtgggtcaagcgcagttgaagtagatgcaagaggatccacagcagggtaaataccttgttgagtcaatgcacgttccaagttagtagttgcatccaaatgagcaaatgttgtagcaggagcaggatcagtataatcatcagcaggaacataaactgcttggattgatgttactgaacccttctttgttgatgtaatacgttcttgaagttgtcccatttctgtagcaagtgttggttggtaaccaacggctgaaggaatacgaccaagtaaggccgaaacttctgaaccagcttgcgtgaaacggaaaatgttatcaataaataacaacacatcttgcccttcaacatcacggaaatgttccgcaattgtcaaaccagtaagagcaactcgcatacgagccccaggcggctcgttcatttgaccatataccatggccgtacgttcaagaactccggatcccttcatttcgaagtataagtcattaccttcacgtgttctttcaccaacaccagtaaaaactgagataccattatgttcttgtgcaatattatggattaattcttgaatcaaaacggttttaccaaccccggcacctccgaaaagaccaatcttaccaccacgaatatatggggcaagtaagtcaataaccttgatacctgtttcaagaacttctgtacttggattcaattcatcataatctggtggatcacgatggattggatcgcgttttatatcggggccaagttctttgccgccatcgatagtgtcacccaagacgttgaaaacacgaccaagtgtttctttaccaacgggtactttaatagaatctccagtatcttcaacatcaagaccacgttgtagtccatctgttccatccatagcgatggttcttacaacaccatcacctaattcaagcgttacttcagaaactaggacagtaccatccgcctttttaatcttcaaagcgttattgatagttggtaattcttcgtcaaggggaaattcaacgtcgataactggtccgataacttgaacaactttaccagtactcatatcgtttaattcctctcgttaatattattcaagtgcagcttgaccaccagtaatttcggtgatttcagtcgtaatagcactttgtctagcacgattatactgtagctctaaatctgcaatcaaatcactagcattatcagatgctgagcgcatcgctgatgaactagcagcatgttctgcagtctttgcatctaagatagcaccataaaccaaactttcagcatattgaggaagaatttcctgcaataatgcttctggtgatggttcagtgtcatactcagcagtaacttgttcatgagcttcgttattagccaaatcatctccaccaattggaagtaatttagttactcggaaactatttgaaagtctatttacaaagtggttgtagcatacgtataattcatcaaatttttcttctgtgtacattttagtaacagttttaacaatttcacgaatttcattgaaagttggaacgtcgctaacaccgcggtattcgtaagcaacttcatgattacgatttcgatagaaatcagaaccagtgccacctaccgcgagaataacggcatcgccttcagtatgcccatgcttttgcataaaatcgtttgtttgcttaatcacactgctgttgtatgaaccaactaagccacgatcagaagtgataattaaatatccagtcttcttgacaggacgttgtgctagtaaatcagcagccgagatagcttggtcagacttagccttaccagctacactagcgctcattaaatgtgatttagcaaggtgagcaacaatactctcaactttttgtgcatacacttgatatccaactgtatgtctctgaatttggcttaacttagcagttgaaaccatttgcatagcagtcgtaatttgactagttttcttagtcgaatcaattcgacgctttacatcttgttcagatattgccattaattctcaccacttttcctctcgttagctgatatccttatttagcttcctttgtaggttgaaaatgttcagcaaatgatttaattgctgcatccatcttatccgtatcaggaagttgcttagtttcacggatttcgtctgtgagctccttattgttacttgcaatatagtcaaagagttcatcttggaaacgttgaatatcatcgacaggaacattgtccaagaaaccatgagttaatgcataaagaatcataacttggttttcaacggaaagtggttgatgaagtggttgttttagaacttcaacagtccgacgaccacgagccaacttagcttgagtagctttatccaaatctgaaccaaattgagcaaatgattccaattcacgatatgaagctaaatccaaacgaagagttccggcaaccttcttcatcgccttaatctgggcatccccaccaacacgagaaacagaagtaccagcatcaatagctggacgagttcctgagttaaagtaatcaccatcaaggaacacttgtccatcagtgattgaaataacgttagttgggatataagctgaaacatcgccagctttagtttcaacgaaaggcaaagcagtcattgaacctccacccaaatcatcactcaacttagctgcacgttcaagcaaacgtgagtgagtatagaagatatcaccagggtaagcttcacgcccaggcggacggcgaagaattaatgagagttcacggtaagcatcagcttgttttgatagatcatcgtatacgatcaaaacatgtttgccgttgtacatgaattcttcacccattgctgctccggcataaggagcaagatataacattggagctggttcagaaggaccagcactaacaacgattgtatagtccatcgcaccgtaacgtctcaatgtttctacttgtgtacgaacagttgattccttttgtccgattgcaacatagatacaaatcatatcttgatctttttgattcaagattgtatcgatagcgattgtagtcttacctgtcttacggtcaccgataatcaattcacgttgtccacgaccaattggaactaaagcatcgatggctttaatacctgtttgaagtggttgctcaactgatttacgttgcataacaccaggtgccttattttctaccggacgggttttggtggtttggattgctcccttgccatcaagtggttcacccaatgggttaacaactcgaccaattaaggcatctccaactggaacttccatgatacgaccagttctcttaactacgtctccttcgtggataccatcatagttacccatgataacaataccaacatcgtttgattcaaggttttgaaccataccgaaaacaccgttagagaattctagaagttcaccagaaagagcattatttaagccatgagcacgagcaataccatcaccaacatatgtaacggtaccagtttcttcgacattaagctcagcttggtagttttctaattgctgtttgattagagcactgatttcctcagccttaatgctcataaaagtttcacctctttacaaatatcgagctaacctattaggcgctgtctaatttgattaatttgagtctgaatactaccatcgtagatcaaactatctgttttgatgatagctccaccgatgattgaatcatcaacttcactatctaagacaacttcactaacttttaaacgtttagcgaattgttctgccattttatcaagttgttgatcacttaatgggatagcagaaacaacttttgctcgaacgattttttcatcagcgtcacacaagttgttaaactcatcaataatcgctatcaaatagtccatacgaccataatcaaaagtcattttgatgagatttccaacgtaatttgaagcatctttagtcaaaatattgagaatttcaagcttttgattttgctccaaacctttgtcagttaaaattttgcctaatccttcattatcattaaaaacttgttgaatctgatttagttcagcacgtgtttcatcgcgttgtcctttttcagaaacaatttcaaagagggcttttgaataacgcttagcaattgttgttttatctaaactcatttgctatcacccaaaccttcgatgtatgaatcaatcaaatccttttgactgttttcatcaagttcttttttgataactttggaagcaatctcaatagataatgacgcaatatcgtcttgtgcacttttaagtgcgtcagcacgttcttgttcaatatcttgtttagccttgtcctttagagacttagcttcattttgagcatttccaataatcaattctcgttcttttgcaccactatctttagcgttgttaatgatagaagtagcttcagcatgagaattatctaatgcttctttacgttgtttagcaagcttttcagcctcgattcgagactgttcagctgagtcaatgtcgttagagatacgatcagcacgttccttcaacattgcattaactggaccccacgcaaattttgcaattaaagccattaatacaataaacaagatggcataaaacaacatatcaccaacgtacaaagtacttccatgtgccgcccctactataatgtgcgaaaacatctattgacacctccttctccgataaattgtttaatttatcatgcctacttattcattacaagaagtgaaataacgaaggcaaggataggcatagcttcaaccaaaccaacaccgataaacattgttgttcttaattgtcctgataattcaggttgacgagccattccttcaagcatttttgcgacaacgataccgtcaccgataccaccaccaatagcggctccaaacatagcaattccagctgcaatagcacccataatagttgttcctcctacctaaaaatatattattattcgtcttcgaccttatgagaaatgtaaacggatgttagtgttacaaacacgaacgcctgaatacttcccaaaaatacggaaaatccttgccaaatcaaggcaagtgggatggcgacaatcatattgacgatgccacccgagaatgcaattcctccgatcatcttaagaagcatttcgccggcaaaaataacaccgtagatacgtagcccaagggtcaagaaatcaatgaattctgtaaaaacaccaatcggtaaccaaactttaaatggcgataaatatgttttttcaaaatattttttaaagccaaattttgcaacacctgaatagtgcgctaacatcattgtgatcaacgacaatgttaaagtgacaatcggatcagctgttgggcttcttagatacgaaacatcattccatgcgatttgcaggaatagaccgatttggttagaaacaaaaataaataggaataatgtgaaagcatatagaccaaaattcttttcttcctcttcatccactgaatcgcggaggataccattggtaaaatcaacgatccactccaaaatattttgcttaccagtcggctttaacttcaaattacgagataaagcaaacactacacaaaaaacaattagtgcacttactaaacctgaaattaagttagtcgtattaaatgtcaaaccaagaaactgaaaagttgaaattgattcaccactcacagaatatcacctcttttctacctaagtgtacctaaaccaaagccaaaaattgacaataatctaagtcataaacttgaacaaaagacagtattttccgtctgaaaatacatttgaaatgataccaccattttggacaaaagacaaaagaataatcgctttatttctatgatattcttcctgttcgttcttcaaaaattgaaatttgttcaatttatctacttaaaatcaaaaagaatttcagaaataaaatttatttatctctgaaattcttaactattcgtttgatttcaatgcttcaaccatatcaacttgccttagtcgacgatgcgtaatataaacaactattaaattaaaaatgaccattaatacagttgctaccacgtatcccattggtttaattgttagtggaaagacgacgatgctagtctcagcttgtttgataacataacttgtcaaaatatttcctaatccaaaaccagctagtattccaatcaaagctaaaataatactttccctagcaatatacattgtaacttctgaatcaaagaacccgagtactttaattgttgacaattctcgcaaacgttctgaaatattaatattgttcaagttatataaaacaatgaaagataacactccagataggagaataaaaatcaaaacaaccggtcctaattgcttagacatgcttgtaactgctgcagcttgatccctcacaaaactcacacctaaaatatcagcattagctttaatccattgcttgcttaatttttgttgattctttttagaagtttgatgtaattgaaccattaaagtttgcatcgtaggttcttttttcatagttttcctataaaaagaagtagatccatacataaagtttccaacataattctgggttacaccaatcaccttaacttcttttttagtttgcttttcattttctatagaaattgtacttccttttctaacttttaaggcagtggcaagtttttctgaaataattaccccctgcttttgcaaatgcaatgggtgttggttttgatagtcccttaaagttacaaatttttcaaattggtgcttattttgaggaatgtccatattgatatcatccacggttttaccgtgcttagttgctttaaaagtttccgtatgggtcgcaaggctttgctgataattctttcccctagcaattgtctgccgaaccgattctaattggttggcttttttagcttgaactacagcatcatatttaataatttgattaaattgaagatctccagttgctgaaatggagttggcaatgccgaaccctgtcaaaataagagctgttccacccgcgatccccaaaatcgtcattaagcctctcagcttaaatctaaataggttacgataactaattttctgattaaaatttagacgtttccaaataaaactaatattttctagcaaaattttcttagctttctttggagatttaggccgtagtaactcggctggaactgcttttgtttccttgattactaccaataaggccgctccaactgtggcaatcattgccaaaaccacagcaattgcaattgaagcccaatcatattcaatgaccggttgaccaattacatactttgtatacattgatacgacaaaacgtggcaataattggttacctaaaaatgaacccacgattactcctaaaattccagccaaaaaagcatacatggtatattcgtaggcaatcgcactcctagaaaatcctaaagctttcaatgttccaatttgtccacgggcctcttctaccatccgagtaatagtagtgaaggtaattaacgcagctaacagaaaaaagaacactggaaagacattcgcaattgcggcgatccggtcagaactatctccatagccagtgaatccaggtaaatcttcacgagtttgccatgtgtaacttggaacttttatcttttcaaccttttttcgctgccgtttcaaattaacttgcgtttccgctaattgttgctcttgtttatcaagctctgaagtagtggttacctttcctccagattgctttttcaattgtgctttagcttgaactattttttgcttagcttgatttaatttctcctgagctctattaagctgatttaaaggttttgcaacaatttcattccttcgctcgttttttcgtttatccaattgtttctgcaaaagttttactttagctttgatagttccttgatactttcctgagaaaacatcttgatgttgaagcttagcaaaactaatatttatcgctgttgcgacaggcaaattgattgcttggtctttaatataagcgaaatactgaacttgaccactaccaacattggctgatcctctagtagaatcgtcgatgtacaggggtgaatcagcaaaacccacaattttatatctattgactttaagattagctgattttgcaaaagtaaactggtcaccaattcgatacccatccttaatttgcgcttgtttatctaataaaatttcattatttttttggggcagacgtccactttttaaaataacttgattttgtctagctggatctttcaaaccgtatagtgcaatcgcatcacgtgtttttccaccaatcacatatttaaatttaatactctccgctttagctctttgaacgcgctctacagctttgatatcctttcgggtaaatcccttatccgaaaatacctgcacatcgctcaaatgatgtttaacgacctctgattgcatggaatggttcaaagcaggcccagttgctttcactccaacgaataatagtacacctaacataataattaggacgattgcggtaaatcgtcctaacgatcccctaatatctcgcattaatagtttattcattagctcaccctaccaaacaatgtctttaactggaactggattagcattatcttttaccgctcgcactcgggcgtcgttaatctgaattacccgatcagccatttgagcaatttcagagttgtgagtaataatgattaccgttttatgaaatttacgactagcatcacttaataattgcaaaacttgttttcctgtttgataatccaaagctcccgtcggttcatcacataaaagtaacttaggattcttagccaacgcacgagcaatagctagacgctgctgttcaccaccagaaagctgggaaggaaaattatccattctttcttgtaatccaactgcttttaaaacttcctcgggcgcttgtccatccttaactaaggaagtagctaattcaacattttccaatgtggatagatttggaattaaattataaaactgaaatacgaatcctacatcatggcgtcgataattagttaattggcgatcgttaaatgtcgcaatatccatattatcaatcataatttgaccactagtagggctatccataccacctaacatatttaatacggttgattttcctgcgccactaggccctaaaatcaccgttactttaccttcttcaacttcaaaattaacatctcgattagcaaaaatttttgtttcacccatttggtacacttttgactcgttttttacttcgatataagccatgctgattcccccgaatttttactatattactaataataaagcttagttcgttttaatactaataacatacaaaaaaagaaggccaatggccttctttttaaagatttattttgtaccgaataagcgatcaccagcatcccctaatcctgggacgatgtaaccatcttcattaagcttttcatctagagcagctgtgtaaatatcgatgtctggatgagcttcttgtaatgctttaaccccttcaggagcagctactaagctacagaaacggatgtctttagcaccacgttttttcaatgcatccacagccataatggctgatccaccagtagcaagcattggatcaacaacgaatacttgacgttcactgatatcacttggtaattttacaaagtattcagttggctttaatgtttcttcgtcacgatacattccgatgtgaccaatacgagcaactggtaataactcggccattccatcaaccatacctaaaccagcacgtagaattggaacaatcgccacttttttacctgaaatctgtttttgaattgatttaccaattggtgtttcaatttcaacatccatcagtggcatatctcgtgatacttcatatgccattaatgttgagatttcattgacgatttctctaaattcttttgtactacagtgtttatctctaatcaaagttaacttatgttgaattaacggatgatcgagaacctcaaacttacccatgactaaactcgctcctttcaaattccttatcaattgtagctaaaaaaacataaaaaaactaggactaatttaatcaatagggtacttttcagttagtttgaacacatctcgcttaatttcttctaaaactgtttcattatccgcatttttgattgctcgaattatcaaattagcaacttcacgacagtcgtcttctttaaatcctcgtgtcgtaatagctggcgttccaattcgaattcctgaggttttaaatgggcttaatttttcttctggaatagcttctttattagtagtaatgaagacgccatctaacagattctgtacttccttaccatttaattgggtcccagttaaatctactgtcatcagatgattatcggtcccccccgttactacgtgcaaaatcgtatcattttcaaagatttcagccattgctttcgcattttttaaaacttgttcttgataagtcttaaattctggttgcaatgcttcaccaaaggcaacggccttcgcagcaataacatgttctaatggaccaccttgattttgaggaaataccgcaaaattaagttgcttggcatatttttcctgcgaaagaatcatgccaccacggggacctcggagggtcttatgtgtcgtagttgtaaccacatcagcaatgccaactggtgaaggatgcagaccagctgctaccagaccagcaatatgggccatatctaccatcagataagccccgacttcatcagcaatttcgcggaatttattccaatcaataaatcgactataggccgaagctcccgcaacaataatttgtggctgttcctttaaagcaatacgacgaatttcatcgtaatctaatttttcagtttgaggatcaaccccataactcactgattgataaaaagttccactaaagcttactttagcaccgtgtgttaaatgtccaccagcattaaggtccatccctaaaattttatccccaggtttaataaacgcggcataagccgcagcattcgcttgggaaccagaatggggttgaacatttacatattccgcattaaagatggcttttgcccgatcaattgctaattgttcaacttggtcaataaattcacacccaccatagtaacgtttgccaggataaccttcggcatacttattagtaagtacactaccttgggccttgcgtacgctatcagatacaatattttccgaagcaattaattcaatattatgttgctgacgcttttcttcacgttcaattgctgaccataattctggatcttgttttgtataattcattgaccaattccccctaatcgatgtcactaaagtatgtgttacctgcagatttttggagacgattcatgtatgcctcgccaatccctattctatcaaatccttgagcaaaaatggtttttattgctgaatcagcatcaaaggttcgtaatccatcgaatagttctcgactagccgtcttagaatctacccctaaggaaatgtatcgaacttggtcgaattctcctaattttttggtctcgaaaatttcatttgtggccataattccaatagtttgatcagtatgcttttggagccaagctacgacaccgtcccaatcctgatcagacactatgtatacttgggcattcggagcatagtgtttgtatttcattccaggcgccttaggaacttcatcttttccgactttatgatggtcggtctggacctcacctattaagggtgccaatgcttgttctgtaatggcccctggccgcaagatacttggcgttgtacttgacatatctaaaaccgttgattcaacaccgatggtagtttccccatcatctagaactccagcaatttttccgtccaaatcatgcaacacatgctccggtttagtggggctaggtttccctgatgtattagcggatgggcccaccaatggaactccagctgcacgaattaaatcaattgttacttgagtagccggattacgaaaagcagctgtatctaatccacctgtaacaatcgaatttaaagctccctttttaattggtaagataatggttagtggtcctggccaaaattgatccattaattttttgcttttgtcgtcaatattagcaaactttgcaacttctgtttggtccgcaacatggacaattagcggattatccgaaggacggcctttagcagcataaactttttttactgcctctggattagttgcatccgcacccagtccataaactgtttcggttgggaaagatactaattcaccagctttgatggcttgagccgctacttgtatttcatcagaactaaataatttactcatttttatcacctatttctttttaacccaaagaattcgatcgtgttgactaatatcttttataacttccgcttggtcaatatacttcttttctaagaaatacttttttaggtccgtaccttgacgataaccaatttcgcaacccaattctccgtgttcgactaaatattgatccaattgatctgcaattcttttataccaaaataatccgtgatcgtcagcaaataaggcttgatgaggctcaaagtcaatcactgattgatccatttcatgcttttcattatccgcaatatagggcggattgctgataattaaatcaaaacgttccccttggacaggttcaaacaatgaccctagcctgaaatcaacgatagcttcatgactttcagcattccgttgagccactgttaaagcatctttagagatatcaaccgccgtgactaaccattctggacgctccaatttaagcgtaatcgctatatcaccactccccgtcccaatatctaaaactcgaagtctctgtcgactgcgcttagttttacttagaatcgtttcgactaactcttccgtttcaacccgtggaattaacacccgtttgtcaacgtaaaattcacgtccaaaaaaagtagccttattcgttacgtattgtacaggctctcccttggcaactcttttcacagcggtttgaaatttctcccactgttcgggaaaaagtttttcacggtaatgcatgattaattcggttcttgaccactccattgtatccatcaagatcaattctggagcattctcgtctccttggttttttcggataaacaaagaagcccatctcagggcttcaaaataagttggaatattattcattacgaagttgttccactttcttggcttgatcatcgagaataagagcatcgatgatatcatctaattcaccattcataactcgatctaacttgttcaaagtaagaccaatccgatgatcggtaacccgattttgagggaagttgtaagttcttatacgttcggaacgatctccggtaccaacagcgcttttacgttctgcattatatgcatcttcttcttgcgtttggtaatagtcataaacccgagcctttaaaatgcgcattgccttttcacgattttgttgttgcgaacgttcatcttgcatcgcaactacgataccggttggtaagtgggtcattcgaaccgctgaagaagtcttattaatatgctgtccaccagcaccagatgagcgataaacatccgtacgaatatctttttgatcgatttcaatatcaacatcttccgcttcaggcattactcctacggttgatgtagatgtatgtactcgtcctgccgattcagtaactggaactcgttgaactcgatgtgcgccattttcatacttcaatttagaataaactttattaccagaaatcattaatacgatttccttgaaaccaccaacgtcagtagcattttcatccacaacttctactttccatccttgggtttcagcataacgcgtatacatgttgtataggtcagcagcaaataaactagcttcatccccaccagctgctccatgaatttccatgatgatatttttatcatcattggggtcagttggtaacattaaaattttaatttcttcttctaaagtagctttagtttcacgaagttcagctaattcagctttaactaaactatccatttctggatctaatttttcacgttgtaattcttcgttttcagcaatagcatcaactgtttttcggtattcacgatacttttccacagtttcacggatttcgccttcttctttagaaagctcttgataacgttgtgaatctcctaaaacttcaggatcagctaatagttcgcttaattcttcatagcggtcggcaacagcctgaactttttcaataatatccatttaattaattcctcatttcttcttcagtcagtgggtgaaaataatggcgacgacaaaccgggtaataagactcattaccaccaatttgaacttgctcaccatcatagaccggtttaccatcatgaacgcgtaaattcattagcgctttgtgcttacagaaccaacaaattgtcttcatttccacaattttatcggcatataaaagtaagtatttagttccttcaaacaattcatttctgaaatcattttttaaaccaaacgtcatgactggaattcctaagtcatcgactactttagctagttctataatgtgatgttttttcaaaaattgagcttcatcaatcaagatacaagcagtatcttcttgggcactagcttgcgtaatcaattccaaaatattcgtatcatcaaaaattggaagagcatctcggcgcaacccaatccggctggaaatttcaccaacagccgttctagtatcaataccactcgtcattaaaataacttttttatcttgttcttcatagttatgagccacttttaaaatttcaattgacttaccactattcattgctccgtaatgaaaaaataactgtgccattctagccccactcctaattttattctccgaaatttaagtatagctgatataaaataaaaattcatctcttattaatataagaaactttcttttttatcaatttcagcttaaaatactattttagatgttttaaagatattcggagggcttaacatgtcatttaaaagttcaattgccaaaatggccggtaaatcgtcatattggtttttacacacatttcgttctggaggaagttcactaccaggcaaaataactactaagattgatccaaccattctaaaagatcttggtaaggactacgatgtgatcgtaatcactggtaccaatggtaagacccttaccactgctttaaccgttaaagttcttcgtcaaaagtttgatcatgttcttactaatccaactggttcgaacatggaacaagggattgtcaccactttcttaactgaccataaatctaaaaaaggcaaaaatattgctattttagaagtagacgaagctaacgtcattaaggtaacacaatatatcaaacccttagccttcgtttttactaatatatttagagatcaaatggatcgctatggcgaaatttacacaacctatcgaaaaatattagatggggttaaattagctccggaagctaccattatcgctaatggcgacatgccgattttcaattcggttgaccttcctaatcctgttgtctactatggttttaacaatcaacccgacggtgagatgaaggcagatccgaatactgatggcgtggtttgtcctcgctgcgaacatattattcactataaatttattagttatagcaatcaaggtaagtattattgccctaattgcggctgggaacgtcccgaattaacttatcaacttacccagattaccaagcttactcccaatttatctaaatttttcattgatgcttccaacttcacccttcacatcgggggactttacaatgtctataatgcactggccgcctattcggtcggtaaatttatgggagtacctacttctagtattcaaaaggctttaaatgaccccgatgagcgggtttttggacgacaagaacaaatcaatgtagatggtaaagaaattaccatcgtgctagttaaaaatcctgttggtttaaaccaagtaattgatatggttggaactgaaagcgaacctttttcttttgttggtttactaaatgctaactatgctgatgggattgatacaagttggatttgggatggaaattttgaaaaattaacgcaaatgccaattcaacaatacatgacgggtggcgaacgttacaaagacatcactttccgtcttaaggtagctggagttgaggataatcaactttggacctatgataatttaaaagatgctgtttcaaatattaaaaatttacctaccaagcgtgtttacgtatttgcaacttacactgccatgcttcaattacgtaaacaattagctacagaaggttacatcaaagaggggatttaatatgaaatataatctaaacgtggctcatctttatggtgacctattgaatacctatggtgacaacggtaatttactagctttaaaatattatgctaaaaaaatggatacagatttagatattgacattgttagtctcgatgatcaatttaatcctaaagactgggatatcgtctttttcggcggtggtcaagactatgaacaaaccatcgtttccaaggatattcaacacaaaaaagaagatctaactgattatattgaagatggcggtccactacttgccatctgcggtggttatcaacttctaggtcattactacgttggtgcgaatggtgagaaaattaaagggattgatgctttagatcactacacattaagtcaagacgataatcgcttcattggcgatattgttatcaaaaatgctgaaactggagaaatttaccatggttttgaaaatcacaacgggaaaactttccttggtaagggagaacgtcctttaggggaagttcagtctggccatggtaacaacggtgaagatcaatcagaaggagtcatttataaaaacgtttatggctcttatttccatggtccaatcctaactcgtaatggtgaattagctaagcgtataattttaactgctcttagtcgtaaatatcctgatgctgatttaactcctcaaaaagaacttactattgaaccaactttctaagactaaaaagagtatctaagaaaaaattttttcttagatactcttttttatgcttcaccaggttcactaacaattaattcaagttttccactatagctccattctttgactgggttaggaagaacaaagtgttgacctttaacaagagtatatgtttttccatcaacagtaatgttcccttctccatctaatactgaaactaaggtgtacaaaccttcacgcttaaagctaacttcgccatctttcaaagaaacttttctcactgagaaatactttgaaattggagctttaacaaatgtagttacctcagcgtcgcctactttgtcagtagtaatgttaagtttaggatcttcatgaggtacgttagttacatcaattgattgttgaagatgaagttcacgtttttcaccagtggttttatctacccgatcaaaatcatacaagcggtatgttgtatcactgctttgttgagtttcaagaaccataattcccttacctaaagcatgaattgtaccactaggcacataataaaattcaccggctttaactggcactttgcggaataatttgtcccattgaccattattaatccaatctgccaattcttcatgtgttttagcgttatgaccgtagtataattcagctcctggttcggccgagatgatataccaacattcagttttacccaattcatgttcatgctcagctgcataggcatcatctggatgaacttgaacagataaatcgtcattcgcatctaagatcttagttaagagtggaaagacttcccccttggcatttccaaattgttctcggtgactttcccatagtttgtctaacgtaatacctttaaattctccgttagcaatggtggctgggccatgtggatgagctgaaattgcccaacattctcccgtgtggtcacttggaatatcataaccaaattcagttcttaaatggtcccctccccaaattttttcatggaatactggatttaaaaataatggttcactcatactctataaaacccctttcatctactcattacctaagaataccacatcatcaattgttctttaagttacatttttaaaaatcttctttggcaaaagtttgataaattttttgtcgatattctaaaaattccaaattaggttgcgggtgaacccgattagataagaataccaatccattttgtgttaaacgatccaataaaataaatgttccagtgaaaccgctatgtctgagtagaacttgatgtggttttctagtaacaaacgcccagccccatgaacggagtaatttagaattagtcgtttgattatcttcgaattgacgcatggttgtttcatccaaaagttcattttcatttgctaacattttcagggtaaatttaaccacatcatgtttggtagaaaatagtcctgctgaaccagcatgcaagcctaacgaagcggccttaggatcatgtacctgtcccttagttaagatgccattgcggacttgcgttggaatagcttgatgaggatcaggggtgaagctactggcttctaatccccaaggctgcaacacatatttctgaattgctacttgaaccggcatatgtaatacccgttcaattataaagcccagcaataggaaattataatcgttataaacaactttttgattaaaatcagctccaaaagttaaattattgtagatagcttcccgtaattcactcgcatttaattcatcccgctgatcaatccaagccgtagcccccgaagtatgcgtcaacaaatgacgtaacgtaactcttgcatctttaatttggggaaggtattggctcactggggcttctaaattaatccttccctgttgttctaaccagagcgtcaaaggaaccgtccccataactttggttaaagaagctacatcaaaatactcaccttgcgctaagcgccgtttaaccggtactacgctgctatagcctgtggttacctcatgaactaaccttccatgatgaataaaagtatagtctgctccaggaattatctgttgctccaacatcgcttgaattaaattttctgtatcagtaaataccatttttattcctaccgtccgtttcctaaattccaatagcattatataacaaaaaatgggttattctccgttttgtttcaaacgaagaataacccattaaaaattaaattacttcaccacttgcaaattgtgaattatacaagtcagcgtagaaaccattttggctcattaaattatcgtgatttccagtttcaacgatttgaccgttattaactaccacaatattttgagcattgcgaatagtagaaagtcgatgtgcaaccacgaaacttgtacggttgctcaataaattattcatagctttttgaatcaacacttctgtacgcgtatcaaccgaactcgtagcttcatctaaaattaaaatttcaggatcagctaagaaagctcgtgcaattgttagcaattgacgttgaccttgtgaaatattagaagctgcttcgtttaaaatggtgtcatacccatctggtaactgccgaataaatgaatcagcatgggctgccttagccgcgttatataattcttcatccgttgccccttcacgaccatacttgatgttttctcgaatagttccggtaaaaagccaagtatcctgaagaaccatcgcaattttagaacgtaattccgtccgttccatattacgagtatccttcccgtcaaggtaaaccgtccctgaattaacatcgtagaaacgttcaattaaattaataatcgtcgttttaccagctccagttggaccaacgatcgcaaccatttctccgggctcaacccgcaaattaaagtttcgaatcaatggtttatcaggaacataacggaagtccacatcgtcaaaaatcatcttagcatctgtcttaacatccgctacatctgtgtgaagatcttccatctctggttcatctagcacttcaaaaactcgttctgcggaagccatggtcatttgaagtgtattagcaatatttgcaatttgagtaatcggttgtgagaactgttgggtgtattggaggaacgcttggacgttacctaaggaaagatttccgtgggcaacttgtacaccaccaattacagcaaccattaagtaaccaatatttttgacgaagttcatcaatggcataatcaatccactgataaattgcgctttccaagctgacttataatacttaacgttttctttttcaaaatcttcaattgcatctcgttcatgattaaaagtcttgattactgtatgtcccgcatacgtttcttcaacctgattattcattaaaccaaggtgtttttgttgagatttaaaaaatctttgtgatttaggtgcgacaaccgcaacgacaatcaaactcagtggcaccgttgcaacagcaagtagggttagtttccaactaattgttagcatcatgtacaataccccgacaaattggaagaaactagttactaattgagtcaaactttgttgtaaagttgaactaatattatccatatcattggtcatccgactcatgatatccccatttgaatgggtatcatagtaagaaatcggtaatttttgcatcttatttttgaaatctgctcgaagttgtgcaacggctttttgagaaacgcgcgtcattaccacttgttgaacaaaactaaacgcagctgaaaggacatacaatagtcccactgacgttaagatttcgacaatcttggtaaaatcaataggaaatttatgcactggtactcccatcttcatctgagctgcacccttcattacccctttaaaaatttcagtcgtagcttcacccaaaattttaggtgctcgaatttgaagaatggtagaaattgccgcaaaaataaggacaacgatgaaaccaaacatccaaggcgaaagatattttaccaatcgaccagctgatttccaaaaattcttgggcttttcgattacaccacggggaccgccatgtccgccaggccgaggcccattttgtggtcgtgctgcattatttgctttagccatttgtttgatctccttccttaatttgtgattcgataatttctcgataagttttatttgtttgttttaattctgcatgcgttccttgcccaaccacttttccattttctaatactagaattaaatctgcatcagcaaccgtggcaattcgttgagcaacgataataacaatactcttttgaatttcaggatcttcccgaagagcttttcttaaattagcatctgtcttaaaatcaagggctgaaaacgaatcatcaaaaacatataccttagcttttttaactaacgttctagcaattgacaaacgttgcttttgtccacctgagaaattatccccattctgttcaacaaaagtatctagtccatcgccatcacgtttaataaattctgtcgactgtgctacttctaaagcatgccaaatttcttcatcagtagcattttcattcccataacgcatattttcacgaatcgtacccttaaaaagaactgctttttgttgcgcaaaggctacttgttcatgtagattgaattggcttaactttttaatatcaacgccattcaattcaattgaaccagattcgggatcaaataaacgtggtaacaaactaatcaaagtagttttaccagacccagttccaccaattacagcaacggtgtctcccgccttagcttcaaaattagcgttatcaattgaaagacgttcagcaccaggatatctgaatttaacattgttataagccaatgtagcagtcgaatcttcaaccatgttttccacgtttacttggtctttaacactattttcagaattcaatacttcactaatacgagctgccgaagctgaagctctcgggatacttacgaagaccatcgaaagcatcataaaactcattaaaatttgagtagcatacgtcataaaggctaccaaattaccaacttgcatcgtttggttggcaattaaatgagctccataccagacgattccaatattagttccactcatcaaaagagtcattaccgggatcatgaaggaaacgattgtaaataccttaataccagttttcatataatcatggtttgcatcagcaaaacgatcttgttcaaattgatcttgattgaatgctcggacgacacgtaccccagttaatccctcacggaaaaccaagttgatccggtcaatctttttctgaaggcccttaaacaaagggaccgcaaaaaacataataattcccacaaaaactgccagtaatggtaatgcaactaagaaaactacggttaactcggattgtttttgataagccataaatcctgctccgactaacataatcggcgacattaacatcatgcgtaaaatcataacaatcacgttttgaatttgaataacatcattagttgtacgagtaattaacgaagcttctccaaatttttcaaattcataattggacatgaacgatatttttctgaagagatcactgcgtagtttattaccaattttttgggcttgagttgcagcaaaaaacacgttaactcccgcaccaattaatcctactagtgaaactaataacatttttaaacccgagttccaaatgtatccaatgttatttttggcgataccattattaatgatatctgaagtaatattaggtaaaagcaaatcacccgcaatttgaaccatcaagaaaactgtcccaactaataccgcccaccacgtaaatcgagactttagtagtttccacataactatttatcctccgttcttcttgcaccaaattccaaccagttgaggttccgttcaatttctttttgaacttctgccggatctgaatcagtgttgtttgaatgtacaaaataatttgcaaaagaatgaaagaaaatcatcattatcaattgctgaatcatattttgatccttttcgttagtcacttttaggagtttccaattgacttcttttttaagattggcacgtagttctttcatacgatctgaatgatatacatcaaacccgggatgtttaccatctttagaacgctttgaaatattggctcctaaaaagaagtttctataaaaatcacgatgattgcctgaaataatttctttcatatattccccagcatattttttaactgctgaaaaaatgtcaccatccgcctcttgaacactatcaatcaaattctcttgaatatcttctaaaatcaaactaaaataatacccgtataaatctgataaatcatcaaagtattggtagaaacttccccgtggaattttcgcatccttaatgatattatttatcgaagattcatatagaggacattgactaaattcacgttcagctgcatctataatacgttgccgtttttcgtcctttaaattaaaaaatgtttgctttggcatttcgacctcctaaaaatgacaacttgtcataaaccacaattatacactttggttttcgatttgcaacaacatttacttaggaatttttgctacaatatcaacatgtagaaaggaacttatttatggcaactaactcagattctttatataacattttgtaccgaattgataataaacccgagatggttaagattcatcacattggctacagaaacgtaattaatatgactttcccggacaccgttcccgtttctgaaccacatgtttattttccagacaattctttattagtcgatcgatttgctgacgaatttgtggctaaaaatagtgacattcttgatcgtttccagcaaaaaacattagataaaaatcatgggctagattctgtctgggtaaccacctcacatatccttgaaaagcatgagtatatgattgaacttactttcgaatcatcatccatgtagaaaggattgattttatgcaaccaaagtttgtacctatgactcctagtggctacgctaaaattaatcaagaaattgatgatttaaagcagacacgtccggccttaatcaaggcccttgccgatgcccgagccttgggtgatctttctgaaaatgccgaatatagtgccgccaaacgtgaccttcgtcggatggaaggccgactacgctacttgcagcgtcaaattagttattccaaaatcattcaaaacactaatcattccaaaatcgatttgggtagcatagtcaagatgcgttttgtcgatgaccatgacgaaatcacctacgagattgtgggaaaacatgaggcggacgtggttaacaacaaaatctctttccaatctcccttaggttcagcacttatgcaccataaaacccatgatattgtcctagttactgctcctgatgaacaatatcaggttgaaattcttgaaattaattaaggtctttattgacgaaacgtattttttagtgtaaattaatagagtaatttgcccgctggtcaaattggttaagacgtcggcctctcaagccggagttacgggttcgatccccgtgcgggtgattttttaatggccattcgccaaattggtaaggcagcggactctgaatccgtaatttactggttcgagcccagtatggccaatcaacctaaaaagagtcatgtagttttcacactacatgactcttttgctttccatttaacattttgttaattttatcccccactactaaataacttcgcccttccaagctagcatccctccagttacattagtaacgttcaatcccttatcttgcaagaaagcacatgtatttgctgagcgtgcccctgaacgacaaatcagatagtaagatgtgctagtatctaatttgctatatttttcggctaattcactcaagggccaattttgtgccatcggtacatgaccatcgataaattctactttctcacgtacatctaaaaccgttaatttttcattttgcatcttttggtaaaaatcatcattttcaatcgaattaatcattagtttactctcctatatctataaaaatacctatcggagcattttatcatattttacggctcattttttataggtttcagtaatcacgaatattaaccttcggtcgaaattactcttgatcaaaccatccaatcgtctaccaaaattttaagctttatccatccctttttctaacatttttcctaccactggaagattgcctatttccgtcattccatccgatggaactactaccagattagcagctgatttagcaagtgtggagaaggcttcaatcgattgatttttgaagtactttccatccgcattagctaacccagtttggactgtatcaatccgataacgttcagcgtctgcgcgtgttttagttgcgtccgcttcagctttagcagtggccatgatagcatcatttttagctttggtagttaattcaatcgaacgggcttctccctctgccctagcaattgtcgcaactctttcacgatcagcagttaattgtttatccattgcttcttgaatcgccctcgatggtgttaattcatcaatgttaatgcggtcgacattaattccatatgtattagttaagtcgccaattgccaaggctaattcttgattaattttagccgttgaaccaagtgcttcgttcaagtccatccgcccaataatatcgcgtaagtgacctcgaactaattgagccattgattcaactgagtctgtattttcatattgatacttagctgcatccgttacatggtaattcaaagttaaactagcagaaacatcagcattatccttagtaatgattgaataattaggaagcgctaaaggtcgcatcgccaaactaatctttcgaattttttggaaaattggaatataaaaatttagccctgattctacactatgactatactttcctaacgtctcaactaaaccctggttattttgcggaacgattttaatacctaacatcaaatattccccctatattcttcttaaagttaagatatttccatttgcttcaatgatggcatattgggcgtcttcgaccacattaccattatcatcaagtaaatatctgtaataaattcctgaaactaatactagtccactctgacttaaatctttacctgcaatgacttttccaataatttggcgtttctcaaaggtcgctggcgtgttagttctatttaagatattaacgatatgtgcattaacacttcgtccttgttcatccgcttccgattgaagtctttcataaagtttttgatctaaacgaagcaaaaaacgtttttcatgatctttgttgcccatcttaactcctttcgtgatatcaaaacaatatcattaatatatcatggttaaagtgtagtcttagatattacttctgtcaataaaaaaaatgatcccttattatcaaggaatcattttatataatcatttaaacttctgaagcccccgaagtagcatctacttctggattgctctcgggtgtttctgaagctccgcttgtgacatcatgacctgcaggctcctcttccgaagctcctgaagttacatcaggctctggattagctgaagcaccagccattacgtcaatccctgtaattggtgaaattggtttggctgctggatcctttattagtttttggccagtggatgctaaataatatttaatgatgggcatgatatcagttacccattcattaacccctcgatagcgaccattttcatcacgcattgctttgtagtaatgcataacatgtcgatccggaccattacctggaactggcatcgaaactagatcagtttctccagtacgaagcgcatgaatcacctgtttaactcggtcaactgctcgccctggatgaacgtctgctaacggatcaccagcttgcccaggatttcttggtgctagcatcttgtcagccggttgatttttgttgtagtaaataaactgattgttatcatctgcatacgtaagttccactggcatggtcttcaagaaataattaagctggtcaaccgttagaattccacgatccaatttaacataagtacttccatccaccgcgtgaactttttgggctgctttttcaacccaatgctcgtcgtgcatatcgaccccttcgatagttgtatttactttacctttagattcaagatcttcgtcttggtaagactttggatcaggagcatctaacatatcaattaccttcacaaatttaataaatttctggatgaccatttctaaaaactgaacagtaccagcatcctttaattgaccttctgcatcgaacgcttccttagcgttccgaagtagaaattcattaccaggcattacaattgcattaactcctggagcttcgaggatctgttttagatggagttgcgctcttgaggaaccctggttgaaataagaagctccaacaatccaaaccggcttgccatcaaagggatgtaatttaaaggataaccattcgatgacatttttaattgcagctgttactgtgtgattatgttctggggtagctaagataaccccgtcggctccataaactttttgatatattttttgaatttcaatattatcacttaaatcttcatcttcattgaaaactggaacatcatcaatatttaaaagttcaatatcaactaagttttcaaaatgcttggcaatgtattgtaataacattcgattataagattgctcacctatagatcccgcaattgctactagtttcatttttcttcatcccttctaccagaaccttcgtcccatgaaaagttttgcatttcctttgcgttattagaattagcgtggtttaactgtttggaaatatctgagaataaaataaagtcttcaaataaaccgtctaatctttcaacttgttcttgatcgattaaatttcccgctgaatcaaaagctttaagcgaattagccagtaaaaattcagagctaggcataatccgcgctttaatttctggtgaatctagtatttgtctaagttgagcctgagctcgtgatgcacctaaagcaccatatgaagctcccgtaatcatcaccggcttatctagcagaggatggattccataggacagccatgctaatgtactaagcaagatggccggaacggaatgatcatactccggagtaccaataatcactccgtcagcattctcaagctcgtgagcaattccttgagcttgttttggaatcgccatttcctcggtctttttaaaaattggcagtcccgccacctcaacgagcttaatttctgcgtcatttttatatcttttttgcatgtactgtagtaatttacggttggttgattttttactattcgttccaacgattgcaacaaattttttcataaatattccccattctatatgtaaaaatatggattaactattattcgcgatttcattgaaacaattctgtagtccatcggttacataaactttcaaatcccgtgtaataaacactgctccaattccgggttgattggccagtagcgctttgcccttttcaattccttgataaaaacaaatggttgaccaaatttctccatcaatcgaacgatcgcttactatggacacgctagctaaattattagcaattggatatcccgtcgctgaatcaaacatgtgatgatatgtctgcccttcaactattaatttccgttcataaatgcctgatgtgccaacagacttttctggaatatgtagaactcccaacgggacgtgccttgatttaatcggattttgaatcccaactttccattttgcatcgggatgctgactccgccccactaacaacacattaccgcccaaatcaataattcctgacgctacgtgttcgctttgccaatatgccttaatttcgtcagcaataaatcctttcgcaattccccctaaatctaattccattccctcttttttaaggaaaacacttcgattttgagcgttcaaaataattgcttgtgggtcaattaattttatccgttctaaaatttgagcatgactaggtttattcgccccatcaaatccaattttccacaatttgactagcgggccaatggccacgttaaaacctaattgccatctactaacttctaccgctttttcaattaaactatacgttgtttccgaaacttgaacagcttgttttccagcttgatggttaatctccatcacttccgaagatggtcgattaactgttaaacgctcttcgaaatcatcaatcatttttatagttttttctaagatatcgacttgatagatggaggctattgaaagattaattattgttcccaaagcatgatgctgtttattaactaactccatttgtccgcccccttttcccaatatatttatatctaatattataccttacctagaaaacgatttcttttgtagtttggaaattattttcaataaaaaaagctatcacaattgtgatagcttctaagtagtacttcagtttttatagacgagcgtttaattcagctgtcttatcttcataacctggtttaccaagtaatgcaaacatatttgacttgtatgcttcaacacctggttggttgaatggattaattccgttcaagtaaccagatacagcaacagctgcttcgaagaagtaaatcatgtagcctaatgtgtaagctgtttgatcaggaatgttaaccgtcataactggaacaccaccgtcgttatgagcaagggttacaccttggtaagctttcttgttaacttcgtccattgtgcgaccttcaagataacgtaatccatcaaggtcttggtcagccttaggaatgtcgatgtcatggttaggcttttcaacattgataactgtttccatcaaattgcgacgaccttcttggatgtattgtcctagtgaatgtaaatcagttgagaagttagcagaagatgggtagatacccttttgatctttaccttctgattcacccatcaattgcttccaccattcgccgaagtattgaagtgttggttcgtagttttcaagaagttctgttgtgtagcccttacggtaaaggatgttacgtaaagcagcgtacttgtatgcttcgttctttgtaacatcagcatccttgtattcgttgcttgcatcttcagcacccttcatcaattggtcaatatcaccaccagcaactgcgattggtaataaaccaacagctgaaagaacagagaaacgaccaccaatgtcatcaggaactacgaattcttcatagttttctgcatcagcttctgtctttagggcacctttagcacggtcagttgttgcataaatacgtttcttagcttcttcttcaccgtacttcttgattagtttttctttaagaacacggaatgcaatagctggttctgtagttgtacctgacttagaaattacgttaattgagaagtcacggtcaccgatcaagttcaatacgtctgcaagatatgttgaactaattgagttaccagcgaagattacttgaggagcaccattacgttgttctttagtaagaagattgtagaaagtgttgttcaagaaatcaatggctgcacgagcacccaaatatgaaccaccaataccgatagcaacgaatacttctgagtcgttgcggatcttatcagcggctttcttgatacgggcaaattcgtccttatcataatttgatggtaaatcgatccatccacggaaatcactaccggcgccagagccatcacgtaaaatctgatcagcagctgtaacaagtggttggatttctgcaagttcgttttcatgtacaaaatctgcaacattagaactgtcaaatgaaatatgtgccattaataactaccccttttgtataaaattctttatctgtaccattatacaataaaattacttaatttggttaagcctatccgatttaacctaatatttactaaaatttaactactaagggtatcgcagattaacaatttacgctttttagttaagatgttttttaagtatcttcatttagttagattgccattcccactttcgactccatcggttctaataaatacgaaaaaaatcgctccccaggtcacctaacaacctcgaaaacgatttttcctactatagtattgcttttatttaaaattattttagcgttgctagtaaagtttcaccaacaatgattaaaattgaaccgatgatgataaattgcatttcacgacgcgtcttgtgttcaccaagtaaccaaattgaaccaaaggttgaaataacaatcccagcttgagcaagtgaataactaattgccaatccaactgatggaattgcaaggaacataaagatgttacctgttccccaaatcagaccagtaataatattcataaaagttggtttcttagtaatttccttttgttctttagcgattagaacaaaaattaaagcaccaattaacatcccaattgcttgagggaagataatggctttggcgtcaacattagcaaaacgaacaattactgtatatccgatataaccaatagttgaaacaaccaaagcacgaattccagctggcatattttcgtcatttcgatctgcagttgtgtcacttttatctttaagtgaagttagtgctgcaccaataatcaaagcaatgacagcaattgtaccaaccataatcatattaccagaagtccactcatgccagattaataccccggctaaggcgttaccagccaattgtaatccagttgaaattggcaccgtctttgaaacaccaatatgtttcatcgaactaaattgattaaattgacccacagcccaaaataaacctgaaatcaaaccagcaatccaaattttaccattcaaagtaggatggtaaagaactaaagtgattaaagaaaagacaaccgcacccattgtcattccaagcgtttgttgagaagcgcttccacctaatcgaccgctaactaatccaatacttccccacatgattgcgggaactaacgcgattaaaatactcatattcaattctctcctatatatatatatctaaaaatatatgtctctctctaagacaaaatatcattttaccagttatgaaagcgaattccaacttttattttgtaaatgtaaaatggtatatactttattccatgtaaaataaattctaaaaatgccgtattatgtggcttttcattacttttcaataaaaaattggaccacactaattttttaattaaaaacgtccatatgttaacttgtttctgaaaaactcgtataatattttttaattttgtgataaaatagatgtgttgcgaagagaaaagctctttgtttgtataaacaatattgggaggaaccagttttatgtcatttattaatggtacatcaacatttgcagcagctcgtaagggtggatacgctgtaggtgcttttaacacaaacaaccttgaatggactcgtgctatcttagctgcaggccaagaaacacacacacctatcttgatccaatcatcaatgggtgctgctaagtacatgggtggttacaaagctgttaagaacctcgttgaaaaacaagtagaatcaatgggtatcacagttcctgttatcatgcatttagaccatggtaactacgaagctgctaaagaagctatcgctgctggatacagttcagttatgtttgatggtcatgatcttgactttgaagataaccttctaaagacaaaagaaatcgttgctttggcacatgctcaaggcgtatcagttgaagctgaagttggctcaattggtggtgaagaagacggtatcgttggtgctggtgaattagctgatgttgaagaagctaaacaacttgctgctacaggcgttgacttccttgctgttggtattggtaacatccatggtgtataccctgctaactggactggtttaaactttgaccgtctacaagaacttgctgatgttattaagacaccacttgtacttcatggtggttcaggaattcctaaggaacaaatcgttaaggctatttcaatgggtatttctaaggttaacgttaacacagaacaacaaattgcttggtcaaacgctgttcgtaaatactacgaagcagacaatgacaagaaagctaaaggattcgatcctcgtaaagttcttgcttcaggtacagaagctatcaagaacactgttaaggaacgtatcgaatggttcaatacaccatcaatgtggtaagatgatccatgaaaaaagcttggcttaatggccaagctttttttgttgctctggaaaatgtaatttaaaagttgttcctttttctggagtactctcgacagtaatttgtcctccatgaacttgcattaattcatggacaattgccatccccaatccagattcacctttggtttgaattcttgatgcatcagccttatagtatctttcccagatatttttgatctgctcttctgtcataccaattccattatcgctaatttggatatcagtaccatctttagcattttgggcccgaatagtaatttttccattttgagtgaattgaattccattttgaataatgttaaataagatttgaattaagcgatctgtatcagcgtataccatcacatcatcagccatatcaataataatcacatcattttcaagtttggcctttttagctagttgtttactaatcctttgagttgcttgctttagattaatctgatgacgatttaaactaattttattcgtgcgcaaccgttcataatccaaattatcattaactaaccgaataagccgcttcgtctctcgttgcattaaatgaacgctttcctctttactatcttcaggaattgcatcatactcaagcccctctaaaataccgttgatggttgtcaatggtgttctcatttcatgagctgcatcagccataaaggctcgtcgccgttcttcttggcgttttatttcatcattagactctttcaaggaagcagtcataatattaaaatcgttggtcaattctccaatttcatccttacgcccagaaactaactgaacattaaagtttccttccgtaaccttgtgcgcagcttctcgaattgcttggattcgccttactaagtaacgtgataagaaatatgaagcaatcactgctacaataatcgcaaaggcaaacgtcatgaaaagattctttttaaccttctcgatgtcagcctgtacgttagctaatggtgatccaatcgaaatcacgcaaaccagattaccattacgattaaaataaggcttatccatctctgtcatggtaacttgtcgacttgacttatcaaaagtcatgcgtgatttggttttgaccgtgtcaccatttttcaattctcttcgctgagctttagtaattcgagaagctatattacggtttggataactaatcgtatttccatcattagtgtagattgtaaagtgaatgtgttgattatctaacagtttttccacaccttgaagctgatcaacttgtacactctttacatcagcagtttctgtatctaacacaattgcttgctgaaaaatactatcagcatattcttgcaaggaatgccatttgttgcggtaaactgagtctttagtaaactgaataaaaaccaatccaacgatcaataaagatgacagagttactaataaaaaggccatcatctgttgaaaaaacaatttcatattaactaatcctcatcgattttactatcatcaaacttatagccaactccccataccgtttggaccacttgtggaccaactgcttctaatttttggcgaagctttttaatatgggcatctaccgtacgttcatcaccataatattcataatcccacactatttgtagaagttgttctcgtgagaagacctgcatgggcttctgcgccaatgttttaagtaaatcgaattctttaggggttaaatctgaaataagcttttcgtctaaatatacctctcgagtagatgtacttatcttaagatgggccgttctaacatcgaatttcgcattctgagcaccttgcgtcatcgtttccctactcattgacactcgtcggtacaaggccttaatacgagcgattaacgtaataggactaaatggtttagtaatatattcatcggctcccatttctaagcctaaaacttgatcactttctgaatcacgtgctgtcaacataattaaggggatggactgcgacgtgcgtcgaagttcagctgctacctccataccatcttttccaggtaaatttaaatcaagtaaaacgatgtcccattgttcaggatcggttttaaaagtttcaatggcttttaatccatcatacacaaatgtaacgttccatctttcttttttaaaaaacattcccatcatatcggaaacagatttattatcttcaatcatcaatatacgcatttcaaaactcctccagttccttttaccttatcaagtatagccttttttatcgaaaaaaatgtgaatataatatcaaaaaagagagacaaacttaattagtttgtccctcttttataaattttagaatttaattacctaattttagtaccaaccttgtgataaccaagctgacttagcagctgaccagctaccgtaacgactcttaacgtagttatcagcaacacgttcttggttagcagctgagtaatcaccatttaggtatgaagatgacaattggtatttaccaacatattgtccatttgtagctgagtatgaaccaccagattccttgttagcaatccatgctttagctgaagcttcaccaccagaaacagttgatgttgtagtcgttgtagctggtgttgatgttgcaactgtacttgtcttagcaacagttgttgtgtttgtcttatttgttgttgtgcttgcagttgtatttgctgttgttgtatttgcagcatttgtgttcttagctacttctggaagagtgttaacttctgattttgtagctttcttgatatcaccagaatttgtgataaccagcttttgaccaacttcaataatatttgcatctttaatattatttgcttttgcaagagagttgtagtcaccatttaagccaaatgcataactaatttctgaaagagtatcaccagattttactgtgtaaatttcatcagcatttgcactactacttgtagttgtaatcatggctgctccaagagctgctccagaaagtaatgcgatagaaagttttgaaagtttagctttaattgacatgtagaaatatctccttgtgttttaaatcatttttttaatttttatgttttcttcttaacaggtaattactttacaggacgtttgttacaaatatattttggatatctgtaaatatcccgtttttttgtaaaaagaagtaatattctgtaatattatgctgcataaacgttgatataaaggcattcatgtttttatgaaataattcaaaatgaaatatttcttctaaaaaaccttatattttaggacgtttttaataaaaaaacaggggaaagaaaactttcctctgtcacaaaagtgtctataaagacgttacttttgcttattcaccccaagcagacataccttgagctttatatacactagcagccatgttaacttgttctgaagttgacatgccagcatgttcaccatgacctaatagttggaaataaccgtatgcccctgatgaagcatttacagcattagcattaccaccagattcacggttgataatccgttgccatgtagcagctgaaacaccggtcttagcagccatttgttgagctactgatccgccatttgaactgcttgttgttgtgctactttgagctggagcaacatagcttgatttagctgttgtttgagttgaagcagcattgttagttgtagttgtattatttgttgtgcttgtagtagctgcattggcagcgttagtattcttagctacttctggaagtgatttaacttctgatttagtagctttcttgatgtccccaccattagtaataactaacttttgtcctacattgataacatcaacgtttttaatgttatttgctttagcaattgaattgtagtcaccattcaagttgaatgcgtaactaatttctgagagagtatcaccagattttactgtgtaaatttcgtcggcatttgcgctaccgcctgttgtaatcattgcggcaccaattgcggcacctgatagtaatgcgatagaaagttttgaaaatttactcttaaatgacatatagataaatatctcctttattttaaaaaaacatatccttgcttcttttcgacaagaaataactttacaggaagtatattacaggtatatttgtaatttcagggataatgggatattttgtaagactttgtaacattctgtaatataagcctcgttattcactagtttaaaaggattctatcaattcccaaagtttctttaaatgaaatatttatttatgaaatcagtcattttatgccaaatttgtgcaaaaaagttctttttgacttaaattcaaacggtgaaaactaggacttttttaaattttattattttaaatgcttccccataattgttaaatcgtacaattggccatccatttcagcaatctgaggtagagttccccatttttcataattttcagatttaaataaaccaatactaggtagattatgtgcaaatatgaaggccataattcgattgatttccaatttaggtgcctgctcctccgcaaacttaattgcttttcgtcctaagtgcattcccctaaaactctgatcaatataaatactaatttccacggtatgcagataagctggtcttccataaaagctactgaaacttatccatccagcgattactcccctaacttttattacccaaagcgggcgagtaggttcttgatgcgcttgaaaccattcctgacgttcttcaactgtgacatattttgtatcagcagtcgccatccttgaatcaattgtttcattatatatctttacaatttctggtaagtcttcttttaaagctatttcaaattccaccgtcaaatccaacacttctttctataattgagttatgaagaataatttatatatccaagtatcgcataaaaaagcgacctgtactgacttatcaattttaataaataggcatattttttgaatccgttttcaacggttgttagactgaaggtataatatgaaggaggtaataacatgcaagatactcaaaagtatacttctctaacagaattcttacgctccacccaaaagggaccttttatttctgtttatatggatattgaaccgaatcagcccgttgaaaagacatctattacactaaagaatctcgttaaacatgctttagaagttttacaagccacttgggatgttgataatggggatgattatcgacaattaattgattcaaccgttgatagttcttcactttggaatatgggtaataatataaattcatttgggttaatcaccaacggaaaaaccatttttgttcaagaattaacggttgaaacccatgatattgcaatggctactgatttaccatttatcttgccaatgttacttgattaccaaaatcgctttgaattttatctattagggattagctacgataaaattcgcctttacgattttacagatcgttacttaaaagaattaccgttaccagatgatgcacccaagactttaaaaaaggctttaggtgacgacattcggggtggagaaactaattcggtctctgttggtaatggaaaaatcagtgttcatggccacaatgacacttctgctgaaaaagaaatcgaccatcgccgttactatcaaattgttgataagtatatcattgataattttggtaatgatccagcgaaaccagtaattttaatgggcctacctcaaaatatgactttattcaaagaagttaataaaacgcctaatcacttcagtgaatttgaattagatctcaatcccactgaactggactacgatcaaaaaattgaagatcggattgaacgattcaaacaagaacgtaataaagccttgcttgaacaagatttagatgagattgataaggcccggggtgcagcattaatctctgccgacttaaatcaaattattacgtcagcaattcatggtcaagtcgatactatctatttggcccagggggttcggattgacggacgtattttagataatgaaatagttgatacaaccagttcgcgagctattcacaataatttgctgagtgacctagccgatctcactattaaaaatagtggtaacgttcgaattcttcccgaagataaacttaatgataaggttattgctaaattacgttacacaatctaaatcaaaaaaagaattttcctttagatggaaaattcttttttattgtcttaatttaatttttctaacgcttttgatggaacttcattcttattcacataattaggtcccttgttgattctcgttttgctaatctcagccttggcataagcccctggcttaaagggtttgacgttctccccatttaattcatacttcatagtttgttctttaccagatttggtcacaaacttaaatttataattatatgaatagctaccaacgattactttgcctgaatcatctttagtttgtaccttaggcggaactttttctggaatcatagtgtaagcttcagtactttggtaagtatcttggtaatacctaaaacccaaaaagattgctataaaaacaaatactattgcaataattgaaagagctcttttcatttaatccacctcccacttacagtttacgggaaacgtggtgagatagctattttaatgcctttaagttaaacaatcaaacttaataataacacgccaattaatccaacaattgaaatgattgtttctagtactgtccatgttagtaaggtttctttaacggataaatcaaagtattctttgaacatccagaagcctgcatcattaacgtgactcgcagctaaacttcctgctccaactgataacaccattaatgaaggatcaattcccgccccttgcattaagggtaatactaaaccggcagcagttagggaagccaccgttgcggatcctaaagccactcgaaggactaccgctatcaaccatcctaaaattagaggagagatactagatgatgcaaagatatttttgaccgcatctccaacaccaccatcaattaaaacttgtttaaacgcacctccaccaccaattaccagaaggagcattgcaattgatttcaccgcatcttctaaagtagccataatatctttactagcaatcttacggtgataacccatcgaccacattgcaaacaataatgaaattaacatagctatactaggagaaccgataaatccaaaaaaattgtcaaccgcattaggatttttaggtgtaacaccgtcgtggacaatcaattcatatatcgttgtgatagccattaagatgactgggaaaagagcagttaaaaccgaaataccgaatcccggagtttcctctaatttaaattgtttttgaggccctaaagcttttaaattaccatttcttttaaacgcttctggaagatattttttagcaatttttgaaaataatacacctgcaatataaacagttggaattgcaataatcactccgtaaagtaaaacctttccagcattagcattcaggactgcagcaattgcagtaggagctggatgtggtggtaaaaatccgtgagtaactgataaggctgctgccattggaattcctaaggaaagaactggaacccctgcttcgatcgcaattgcgaatacaattggtactaataacacgattcctacttcaaagaaaagtgcaatcccaataataaacgaagcaactacaacagcaatttgtaagaagcggcgtccgaatttatcgattaaggtattagcaatccgataggctccccctgcgtcggcaaccaagcgacccaacatagctccaaagccaaataccaacgctagttcacccaattgactcccaattccattttgaatcgtggtggcaatctggctagccggcatccctaaacctaatccaacaaccaccgcagtaataatcaatgaaacataagtattcatcttaaattttataattaaagttaacaataaaattattccaataactaagaccataatttccataaataacacgccccatctaagtaaccgctttctttttgctattaaattaaaaagaccgttgatcgtctctttaatcttcttcagctatttttgcatgttcattaggatgatttctttgaaattttgcaatactatcgtattctccagataattcatctgttaatctaatccaaattggtagcaattctcgataggaagcaaaattctcttgattgggtttatgtgtatttgttaccccaaccatatccttaacaacgctcaaatcgtcgacaattcccaaactcttcatccctatcaccacggcccccagcgctgagctttcaaaactttctggaatattaacatcttgttcaaaaatatcagctaacatttgacgccaaagtgcgctcctagcaaatccaccggtggcttgaattgatttcggtttaccggctactccttcaatcattagcattaccatgtaaaggttatatacaatgccttccaaagctgctctaaccatgtgtgcacgagtatgttgacgcgttaatccgaagaaacttccacgtgcgtttgcatcccaaatcggcgctctttctccgcctaaatatgggtgaaacaatagtccatctgcgccagctggaatcttagaagcaatgtcggttaaaatttcataagaattgacttgcatttgttcagccgtaattttttcaggagagaataattgatcgcgaacccagcgaaatacaattccaccattattgaccggtccgcctactacccacttaccatcatctaagtaatatgtgaataatcgaccccgtggatcaacaactggcttatccacaaccacgcgtactgctccagaagttccaattgttaccgccaaaactcctggttcaattgcattaacccctagattactaagggtaccatcactagctcccatgatgaacggagtatcttccggaatcccagtcacctccgcatacgatttagctaaccccgttaattgatattcaggggaaactaattctggaagctggtctcgcgttacacccgtaatttcaagggcttgttcatcccaatccatcgtgaaaatgttaaatagtccagtcgcgttagcaagagagtagtcctgaacatactttccatataatcgaaataaaacataatccttaataccaataaaatgagtcgcctttttaaaaatttctggttgttcattctttaaccaaatcaatttaactaatggtgacattggatgagtgggtacaccagtataggcgtataattgttggccaagtccattgtcctttaattcttcagcatacttgctcgaacggttatctgcccaagttataactctagttaatggatgattatctttatccatcaaaatcaaactatgcatcgcacttgagaatgatactccctttaattcaccattcttaacatttcccttacgcatcacttcagttaatccattaataactgcttcaaaaatttcggctggatcttcctcggccatatctggactatcctgatataaaggataaggattgtttgcataggcaattgaatttcccttcatatcaaataaaactacctttgtactagtagtgccaagatcaacaccaatcatataatccatattctgtacctcaactattctttatgatcaactttatgtccgccaaaaccatttcttaaggcagatactacttttcctgtcatcgtatcatcttcttcagaacgataacgcatcatcaacgaactactgattacaggggttggacatgtaaccttatcgcctcttcgaccgtccaagcaccctctccagaactatgcataaccccttttatttcatccaagttaggatcgttactaaaggctgattgtgtgagttccatcaaccaacttcggacaaccgatccatggttccatactttggcaacggcttcattatcataatcaaattcacttttagaaagtacttcaaatccttcaccaatcgcttgcatcattccatattcgattccattgtggaccatttttaaataatgtcctgaaccagcttggcctgtataaagatatccatctttttcagcaatagctttaaataatggttcaatctcctcaaacttgtctttgtctccgccaatcataaaattacctccatggcgggctccggacatccctccagatgttcctacatcgaagaaataaattccagctttactaagtacctgattatgatgaagtgaatcttgataatatgtatttcctccatcaatcacaatatcatttttacttaataaattacttaattggccgatagtgtcgttagtgggagctccggctggtaccattatccaaattattcgcggttgatcaagttgtttaactagctgttcaatactatctaccgtatttatgttatgcttttcagcattctctctagctttgtcaaagacatcaaaagccaatacttcgatattattatctaacatattttccgctaaattgagtcccatttttcctaaaccaatcaatccaattttcatgacgttccctcatttcttcatatatctcttaatttatatttagattgtatgaaaatatgttacatattgcaagcgtttacaagaaaattattttcttgtacaattttgatgttataattaaataaatcacaaactcgaggtaatcacgatggcaaattttaatttaagacttcaagcttatcaagccaattttagcgataaggaaaaagaattagcacaatttttattaaaaaatcaggcccaaactacccaacttacgatatctgaacttagccatagaactaatatctctactgcaactatttcacgctttgccaaaaatctaggttttgataattttcaagctttaaaactctgcatagctcaaaatatagaaactaataatccctatgtagaaatcagccctgccgattctcctaaaaccatggctaagaagatatttaaactgaatgtggatactttaaatgctactgaaaatgctctaaatggaaaagatttggatcagtgtgtaaatctaattttaaacactaaaaaattaggtttatttggcttaggtgctagcaatattgttgcattaaatggatttcataagtttttacgcaccactatcgaacccatctatgcaagtgattttcatatgcaattaatggaagcagcccgcctctcaaaaaatgacgtgatgctgttagtatctcattcgggggaaaatcgggatgccctcgccctagctgaagtcgctaaagaacgtaatattccattaatattaattactagttctgctaactcaactctttcaaaaaaagctgatgttactcttgtttcagtcgctgaagaatcactttaccgtccggatgccttacacgcactcattgctcaaattagtataatggataccttatttatgatgattgctattaagaccaaacgaaatattgctaccaatattcgacacgaaattgataaaactagaaatagacaataaaaatttcaaaatactgttataatgcttttatcaaacaaactggagtgatcactatgcctcaaaagccattaacagaatacacaattgatatcccaaaggttgctgaactattagaagataccgatagtttacatactttttttattaaacttactccgggatatcagcgcgaatgggctcgttttatttttggagttaaatctgaagcgactaaaatccgtcacattgaacagatgaaagccgtttttgaagccggatttaaatcaaaacgagcttatgatcagcgcaaaaaataagtttagaacaaaaattttgtactaaatataaaaaactccaagagaaccagattgcatctagtttcttggagctttttactactttgtcaatggtagctgtagtatggcttaacactattctcaatagcgaccgcgaccatcgcggagacctgctagtgtaggccatggttttaccaattaatggcaatatcgacattgatttcttaacttaaacctcgaaatggaatgtgactatccattttttgtagaaagaatttttaaagaaaaatgtaaataattgaattgtactcagtaatttttagctgtgtgtttatttttcagggaaaactttgaataggtttagttctgaatctgttttactagattagaaaacccaaatttgttagtagacattattcttcagcgtgaattcacatatagagttgtttaaattttactaatcgacacaagcatacctttttattgaccagaagcaagtctggaaagaattgcattctgctcatactcactacaatgtgagataaccccaaatattagctggcatctaaaaaatctagttgttaatatgttatagtttcggatttgtcgtcaggaccagataagataggtatttttcttttttaaagagcctataatattgattatttaacgatacactcacaaaaaatcagcgtcatcttttaaatttatagaaaacgctggattgcattaaaaactatctttactaaaatttctcgatataccttacaaggctgaattgtacaaataaccattgttaatccttatccaaataaaattctttaagtcggtatgtagttacaggctcaacgtaataattatatttagcaactagatcacaaatttgatcgccattaattaatgtaataattcttgtaccttgacgagcagtttcaacggcttctcgagtaaaatctgaattagtaataaagatcccaaattcggcattgaatttgtccatagcaccacgaaatttatcaatctcaggagcggacaccttactttgccaacgtttaacttgaagagctacacgagtagttcgataatcatccgaacggacatatccaaaaccatctaggcctccatcagcgacaaactttacaccaattacatcgtcaacatcaatgtccattttctttaataatcctcggcagaaaagttcaaatttcttaggattcatctttattaatgcatttagtaattgctctcgccaagattcttctctagcatcaggctcaacctgttcactttcaacttcttcgataaccgaaattttattctctttttcctcaactaactgtttttcaacaataggcctcacgtaccttgctgcatcaaattctagaaaattaatattacgacctttttttgataactctaattctcgattatcttctgtttcgatataatctgtcatgataagatacttaatggcaaaattcaatgtccaattaaagggtctgtacttgttgcccgttttttttgatactctaactttatctacttcattatcggaaattacatctgaattatctcgtatatcttgccgaatatcctttcttgtaacttgacctcctaatcgatgcattgcctttaatacctcattcatagtaatattctcgatttttatttgttgactagccatcacattgccctccatactttcgttctgtaatcaattataatatttaatccgtttcttatcataattttaataaaaaagcgtactacttattcgaaaataagtagtacgctttttaatcaatgaaatttaaaatttatttttatctaaactcgttctaacaccgtaacgctttctacgtgtggtgtttgtggaaattggtccacgggaacgattggttgatttactacatagccttgttctccaaaacgatcaatatcacgcacaagggttgcagggttacagcttacataaacaacccgttttggcttcataccaacagttgcatcaataacactttggtcaagtccttttcgtggaggatcaacaacaacaacgtccggtttcaagccatcttcttgccatttttgcatttgttcttcggctttaccaacaacaaattcagtattacttgcgttattttggaaggcgttgattttagcgtcttgaacagcttccttaacaatttctacgccgtaaacttttttagcagcttttgccatcgcaagcgaaattgtaccgattccgctataaacatcaatcacagtttcttctccagttaatccagctttatcgatagcaagttgataaagtttttcagtttggatagggttaacttgatagaaagaatgagctgaaataatgaaatccaatcctaaaagttcatcatgaataactgattcacctgcaagaactcggtcttcatctcccataatgacgttagtttgtttgtaattaatattttgaattacactaacaactccatcaatagcagcaattgcttctgtaatttctgctagatgaggaacatctttagtacgcgtaatcaaaactaccatgatctgtcctgaacgacgtccacgacggaccataatatttcgaataatccccttattttcggcttcacgatatggatcaatataaaattcgcgtaaaatatcgcgtacttcaacgattaccttatcaattactggatcttgaatataaaaatcttcgataggaactaaatcatggctgtttcgcttgaaaaagccagtttgaagttttcctttaattttacgtactggaatttgagccttgttacgataaccggttggattttccattccaactgtatcagccacttctaaatcttctaaatgtgactttttcaataagtttttaatttgattttgtttgaattttagttgtgcatcatacgtgatgtgttgtaatggcgcaattccagtttgggtataagcggcatcattactttctacacgatctggactttcttctaggaccttttctacacgtccaaaagcaaaattcttttgaaccttaataatcttagtttcaatcttttcaccaggaatactatcagcgataaaaattggaaaatgttcaatcttagcaactcccatgccttgatatgttaaatcttcaatttctaccgtatatactaaatttttttcaacaggtgctgtactcttcatttatttcccctatctatttactgataaaaacgggctggcacattaataccagcctgctttattctcgtgtgctactcaagaactgtaacgcatttcagcgtatttctcaagcttttctttaatctattttgttatcatctggaagattttgaacttcttcgacaaattgttgttccacttgtcgatattcgtcatcttctttaatcaaattaactggtacatcatctaagttagtgaacatttcaatatggcgttttaaatttttaaataccataggagcatctccaccatactccccatccaaattaaccataacacgatcgtttactggacggaccgtaacttttcgtgctttccgatagatgatccgcgaatcattgacatgttttccatttaaggctttaaccattaaatggagtaagttaggcaaattacctgattttacaataatcattgtaaatttcccatcatccagagaggcatccggtacaatttgttcaaacccaccaattgaattcgttaacgcgaggaaaaacatggaagctttaccatgatatcgttctccatcatattcgatgtccatttcaaccggttttacccgtggtagtaattctgcccccttaacaatatatgcaagatagccaaaaatacttttgaggtttgaaggcacatcataagttaattccgttaataaaccaccggccgcaatattaatgaaataattttcgccagctttaccaatatccatctttagtcgttgattttgcaaaataactttggcagcacccactggatcttcgcgaggaattcgtaaagcccgcgcataatcattggtcgttccagttgggataatcgccattttaggacgtctaagtaacggtgcaattccatttactacttcattaatcgttccgtctccgccagctgcaaccactaaatcaaatccatcttttgcagctcggcgagcctcgtttttggcagaatcgggttcaggtgtagtagcaaaagcacttgtctcatatcctgctttctcaattaccgcaagaatttcaactaagtgttgtttaatcatttcacgtcctgaagttgggttatatataattcgcgcacgtttccgcatcgtacgtcatcctccgattctattcctctaacgagaattaagttcttgcattaggattttgttaactactttagggttagcttgtcctttagtttgtttcataatttgtcccactaagaagcccactgctcgatctttaccattcttaaagtcagcaacagattgttcattattatcaacgatttctacaatcattggcttcaaaacagctgggtctgatagttgaaccagtcccttagctttaacccaacttgtaggttcttcaccttgggtgatagctttaaagaccttcttagccatcttagaagaaatcgtttcatcagtaatcattttaaccatgctggccaagtgtccaggagttaatttggtttcttgaagatcgactttttggtcatttaagtaggcattaacatcccccatcaaatagttggccgttaatttaggatcagctccttgagcaacagtagcttcaaagaaatctgacatttccttagtttgagttaagaccatcgcatcgtaatctgtcaaaccaagttcttcaacgtaacgagcgcgtcgcttaccaggcatttctggcatcttatcttcaacgtctttgatccattcatcatcaatggtaatgcttggaagatccggttctgggaaataacgataatcttctgccccttctttgacacgcatcaaaatagtttgccccgtagtttcatcataacgacgcgtttcaggacgaacttgtccaccagctaacagaattttttgttgacgtttttcttcaaaagcaagtcccttacggacaaagttaaaggaattaatattcttcaattcagcttttgtaccaaattttccagaacccagtggtctaatagaaatattaacgtcgactcgcatggatccttcttccatcttaacatctgaaataccagtaaattgaattcgttgacgcaacgcttcaagatatgcataagcttcatctggtgattcgatatctggtttagaaacaatttcaattaacggagtaccctgacgattcaaatcaacataagagtatccattgggattatgactatttttaccggcatcttcttcaatatgcatctcggcaataccgacttttttctttttaccttctacttcgatttcaatccaaccatccgtaccaattggagtatccgcttgggtaacttgataagccttaggattatcaggataaaaataatttttacgatcgaaatgttgggttctagtaatattagcatgtaaagctttggcagccatcatccctgcctcaaccacacccttgttagtttgaggtaatactcccgggtatccccagtcaattacgttcgtattagcattaggttggtcaccaaattcaacgggtgaaggactaaaaattttcgagtttgtttttaattcaatgtggacttcaagtccaatagttgttttaaaattcattatttgtcctccatttcagggtgctttgaatgtacctcggtcgcagcttcaaaagctgccccagcttgatacatcgtttcttcatcaaacggtttagcaataatttgtaatccgactggcatattatcactaaatccagcaggaactgacattgctggtaaacctgctaagttaactgggattgttagaacatcattcatatacattgtagttggatcatcaacttcagcgcctatagcgtaggctggtgttggagctgttggtccaataatcaaatcataatcttcaaagattttattgaaatcattaataattaaagtacgaacttgggctgccttcttaaagtatgcatcatatgtaccagccgataacgaataagtccctaacatgatacgacgctttacttcatctccgaaaccttcggaacgtgatttaacatatacatcttcaagatttttgacattttgagctcgatgaccatatctaataccatcgaagcgttgtaagttagatgaagcttctgaagaaccgataatataataagctgctacaccgtacttactccgtgggagcgaaatttcttcaatcgttgctcccaaattagttaatgtttcaactgcctgacgtacgacttttttaacgtcttcattgattccatcgcctagatattccttaggcaaaccaatcttcatccccttaatatctttaccaatcttagatgtgaagtctggtacctttttgtcagaactagttaaatcgcgctcatccattccagcaataatattcaataaagctgcattatccttaaccgtacgcgtcatgggtccaatttgatctaaacttgatccaaaagcaatcaaaccataacgtgagatacgtccataagttggttttaccccaacaattccagtgtatgaggctggttgacgaattgagccacccgtgtctgaaccaagagcagcaattgaatttccagctgaaactgttgtagcagaaccacctgatgacccaccaggaaccttagtatgatcccatggattacgcgtatcaccaaagtatgaagtttcagttgatccacccatggcaaattcatccatatttgtcttaccaataataattacatcattagcttgtaaacgttcaataacagttgcattgtagatgggtataaagttactgagcatcttagatgcagcagtagttttgattcctttggttacaatattgtctttgacagcaatcgggattccggcccaaatattatcagggttaattcccttttcatcgatagcacgggcttgagctaaagctccctcgcgattaatggtcacaaaatcatttaaaactttttggtcggcttcaatttgatccaatgtttctgaaactaattcagttactgttaattctttatcaactaacttttggtgaagctctgttactgttatatcaaaaaacttcattatgcttccccactttcatcaagaattgctggtacacggataaatccgttttctgtttcaggggcattagctaataatgcttccttatcattcgaacgaacagctacatcttcacgcattcgatttaattgatcagtaacattaaaagtaggttcgacattggttgtgtcaacctcatttaaagtatccactaaatcgataatatcttcgatttgatccgtaaatttttcaagttgttcgtcattaaattttagtttagctaacgtagcaacatgttctacatcttttttagtaatgttattttcagttgtcattgatttctccttctaagatttaataacttgaaaagacatgagaactaaacgtcttttctttagctgagcgcgataggaaactctggacttcatcagtagatttaattgttatatcaatattaactccactaggaagatacttttcagcctgagttgaaacaaattgagtaaaactgttaatctcagtctcactatagaattgagtcgtgattgatacactcataccttccatcgatttaccgtcgtatcttgcttttgcagtaatcccacttaaattagggaagaagctttctacttgcgtcttaaagttatcaaacgcactagaatcattgctattaggtgaggtttccgtatcactaattggataaacaacattcttgtagtctaagtctttccattttgcaagcttttcaccggaattgttagaataacgcataaacgttccaccaactaggctatcattggaagcttgtttatagactgcaatcacaattggaacatttttaaattcagatttcttgcgaagtcgttctagcactttttgagcaatttcttgactcttagccttaatctcggcatctgagattttagtctcatattgagcgccgtattgttctttttgataataatcaaccgaattcatcgctaatccaattgtaacccctttgagtttcaaagaagttcctgatttttccatataatcctgttcttcaagagcctggagataaattgggtttcgtttgtctgggtcttttgaaccattatccttagggttcagcccttccggattgctcttagattcccgatcaagccaattttgaacagtatctgaactcagatattgaccttcttggaaaacatattgagaggttggaaaaatctttttggaaatgtcttgtaatccactctcgaaactcttggtgttattaacattaccattttgatcggcagttaatccccgtgacttgcttgtcacgtattttccatttttaatcaccccagcatacgagcctgaagctgatcctgttgtttggtaattattttttttgttcttttttccggtcacattattggtagaagattgcattgatgaattatctaaacttccacaggcagtcagtcccacgcccataactaatgtggcaactaataaactcaattttttagttacattcatagaaaagtttcctcaatctttcatttatccctaattataccgctaacctaaaccctgtataaaattctttattcaacaacccgtttaattggtgcaaaagcggccaataaccgcttaattccttgatctttaaaggcgatatccaattcggcatcttctccagcgccagacaccttcactacggtaccaataccccaagctttatgttcgactttatccccagcattccagctaactttaccagctccgctaccattagatttaaccgccgtagcatgggtattaccataaacactagctgttgcgcgtgcatttcggttattgtcaaacggatatgatttttctttagtatttcttgaaaaactcttttcttcattttcactcttcaaatattgtgatccaatttctgaaatgaaccgtgaagctggattagtttgtgtcctaccataaagcattctagaataagcattcgtaatatacaacttttgacgtgctcgggtgattccaacataggctaatcgtcgttcttcttctaattgttcttgatccatcattgctctagaaagtgggaaaattccatcttccatcccaactaaaaatacgattggaaattcaagacccttagccgcatgcagggtcatgagggttactcctgatggctcttcttccacattatcttgatcagaaaccaaggccagatccgctaagaaatctactaattgaatgttatcaccattttcgtcagcaatttcatttccctcagcttcattcttatcgtcaaattgcttagtaactgttaaaaattcgtcaatattttcaaggcgtgcttctgattccatcgttctagatttttctaaagcagctcgataaccagtttgttccaagactgcttctgttaattctgtgatatttaaaaattcacctgatttacgtagagcgtcaatcatcttagcgaaatcttcaattgcattgcgagctcgactagaaattccatttgcaatctgaacactacgagccgctttcaataaggaccaattattttcatccgcgaaagcttgtaatttagcaatagaagtcgaaccaatcccacgtttaggttcattgatcactcgttcaaaactcatcgaatcgtcttcgttagcaatcaaagtaaggtaactcagtacatctctaatttccttacgatcgtagaatttatgtcccccgaccattaaataagggatgttggatttaacaaacgtatcttcaattactcgtgactgtgcattcgtccggtaaagaatggcaaaatctccgtaatttaaattatgctctttaatttgctcacgaattttttgaacgatgaaatgggcttcatcaatccccgtctggccacgataatatgaaattttttcaccttcatcattatcagtccaaagttgtttaggtttacgttctacattattttcaatcacatcattagcagcatttaaaatattttgggttgaacgatagttttgttccaacattacagtctttgaatctggataatctgattcaaagttcatgatgttttgcatatcggcgccccgccaaccataaatactttgatcagaatcaccaactacacagatatttctaaaatgtttagctagcatcgttactaattgatattgagcctgattagtatcctgatattcatccacatgaatataatgaaatttattttgataaaatgataaggtttcaggattcttttggaaaagttcgatggttttcataatcaaatcatcaaaatctaaagcctgattgttctctaagcgacgctgatattcttcatagatatctgcgactacctgttcatatggagtacttgcattctcacgataagtgagtggcgtttttaaatcatttttagcattggaaatcgttcctaaaactgaacgtggatcaaactttttaggatcataatttaaatcggctaaaatatgtttgactagggttctttgttcgctaggatcggcaatcgaaaatgctcgattatatccaagttgatcaatatttcttcttaaaattcttacgcaaagagcatggaacgttgatacccaaatttcagcagcttcatcacccagcaaactagtaactcgctcacgcatctctctagcagccttattagtgaaggtaattgccaaaacattccacggattaacacctttttcttctattagatatgcaacgcggtgcgtcaaaactcgggtcttaccactaccggcgccggccataatcaataacggtccttcagttgtctgaaccgcttctttttgcatatcattaaggccttttattaaattaatttctggcaatttgttcaatcctctctatctacgtaactaaaaaataaccacaaaccattatatcaaaaaaagccggtttatttaccgactttaacagagttttaccaaatatcagtgttatcaatttgttcttgaatttgtttgacatcatcaccatctgccaagatatatccgatatgctgtttagcatctgcttcatctacttgtggatagaagtggaaatgccaatttgatttaattaaccactgtgttttgattttcttcatttgttcatccgtaatgtttaacatgatggttggtacttggagccggatgtcactaatcatcattccactcaaggcccggagcatttcttcatagaccgtggtgtttgacgctagattaaatacgttttgttcatcacgaattccaggtattaattgttcaaaatagatgtcctcaccatcaacatagaagacgattgaaaatacacctacgtactctactaaaccagcaattttagttgctgcttctaatactgaattttgaacttttgaatctaaatcaactggaactttagtttcttttagaaaatggttttcgtaaacattctcgaccattgggaacattttttgccgattattttgatctttaacaatacttactgcgatctcttttccaccggtcataactggttgaagcatataagttccacgttctaatagtacgctggcctttggaatatctatctcactcttaagaattaactctttttcagtcatagcatcctttaagattggacgaagaatagccggatatccaatttcattaattgactcatataaatcgtctaaatctacaactgtaacatagggcgttcccttaatccctgtttgttctagagttgctcgttctaggattcgatcttgatttaattcaagtaatttaactccttgtggaattgaaacaaattgttgtaaatattgaattgttttaatatcaattagttctgattcgtatagaacaattttacaacgttctgcaaagcgttgtaatttttccccatcatgaatactaccgacaaaactaatgtccgcatattgattcacgccatttttctcagaagtaacgtatgtagcaaccttaaaacccattgactttgcagtagcaacgagttgtacacttgaacgtccttctccaataataccaattatgtcccctggataaataatttttctagaggtaattacttcactctccacttaaatcatcccgcctgttcatcaatcttcttacttatttattcaaattcaacttgaccatcatccgttagcgccttaattcttgctaaagattctaactgaatgtcgcggtctttaataatttggcttcccttttggaaagtcttttcaatcacaattccgactcccactacatcgatattagctgcatccgcaatatcaagcaatccagaaaccgcttggccattagccaaaaaatcatcaataatcaaaactcgatcttcttcatcaataaaccgttttgaaatagaaatttgattactagtttgctttgtatatgagtaaactgacgctgtgtataaatcatcagtaagggtcaagctcttatgctttctagcgaaaacaactggcacatccattgctaagccagtcattacagcaggggcaattcctgaagattcaaccgttaaaatctttgttacgttctgttttttaaataaacgtccaaattctttgccaatttcaaacatcaattgagcatccacctggtgatttaaaaaaccatctacctttaaaacgttgtttggtaatacgattccttcggacttaatcttatcttcaagtaacttcataatatccccctatttatcatagttatttaaaccatatttttgaattaaattaattaatttactaggataatccggatcagttgcatattgggcatcatacagtgcttgcgcagcttgtttataatctgccgcattgatgaccgcttggtactgttgcgaattccaatttgttccgttaaccaaaagaagtgaatgatctcgcattgactcttgccatgaagaataaaccctaaatcgagctgaaacagttacccatctaccatttacgaattcctgcgtcttaaaatacctactattagaatcggaatcacctttaattccatagtagttattaaactttttagatagggtactctgtccccaatccgactctaaaattgcttgagccattgtaatgctaggtaatatgccatattgccgctgcatttgttgggcatacggtccaattgttttaataaattgctgatgttgagcatcattagatgcttccgtagccacactatcgtccacgacattatgctgagtgacatataacttcatgctaactgctacaatcaggcataatgctaacaaaacaccgatcaagttagaaacgtgtaactgacctcgattataaaaagaactagattttcgtcttctttttctcttcgccactcgcaatccagacccttcattttggtgtacgtattcagtttaactgaaccatcaaaaaaatcatagtcctgtgacaactaatcaagttaaaaattaattttttctttcatattgtctgaatctttcttgtcccactttagtatattttaacagcggaattgaaattagcggtgcaatcacacctgctgcaatggcctcaggtattccatgaacccccgccacagacaataaatatggcatcaaatcttgaatattgagagctgcataaattccagaaccatcgtgaaaaaagatgtaaatcatacttaaaactaaactagtattaaccaaagagccaatgatcgacccgacaatcaaagtaatctgttgtttaatattaattcttatcatccagttgactaccaaacctgttactaaaccgattaaaatgcgaggtacaattgataccatggggttagccatcacgatgttactaaaaggactcgctgttaaagtaagtgcctttatccaatcaacgatcccccaaattccaccaactatcgcaccatctaccggtcctagaacaatcgccgcaataacaaccgtgatgtgaattgtagttactacaaatattcctacggggatatatcctaatagtgggacataattttgaataataataatcgctgcaaataacgcaagtatactaatcttcccagcgttggtttttcttgtcattgttaaagctccttactgtaaaaagtattctatatattatatcattgaggcgattaatcaaaggaggattaagatgaaaatttatatatccgaccaaattcctaaacaaattaggactaatttacccaaagacaatgtgacataccttaatagttcgtctattactaaggcagacttaaaagaaatccaagttgcttggggctatgaccatcatgtgcaatctctattagatactcctcaccatcagttaaaatggattcaatcttttagtgctggaattgattattttcctaaacaacaacttacagatcaaaaaattactttaaccaatactagcggtgtccacagcgaagccattgccaatacggttcttttatatgccttatacttcatgcgcgatatgaatttagctcttaacatgcgtcgccaaaagcaatgggatggtagtcgccattatgaggaactaaccctactctcaaataaaaaatggttaattttcggtactggtcacattggacaagaaattgctcgagaagctaaagctttaggtggttatactaccggtgttaaccattctggtcatgcagctactaattttgatgataccgtagcagataacgcttattcaaatatcattcaagatgctgatattattgtcaacattctccccttaactccagaaactactcatatgtttgaccatcaattctttaatcaattagagcatttatatctatttattaatgtcggtcgaggaccatcagtcgatacttctgccttaatgcaagctcttgatgatggtcgcgttaaacatgccgcattagatgttttcgaagaagaaccacttgcttcagatagcccactatgggattatccacaagttttaattacaccacataattcagcggtaagctctgagatgctgccaggtgttcaggatgtgtttgtccacaacttacaaacctttctaaaagatgggcatcctgatacaaatattgttgatttaactcgtggttactaaaaaaacttggtacatagtaattttaatagactccctagagttgttattattgctacgtaccaagtttttttaatttttaatttgattaactttttgtaaaccttttggggtaactttatataagcctaccttataatcttcgtgatatgtttttctcaacattgttgtgaaagttcggtgccattccggtaatgccacatattggtatctttgaacaacttttttaaagtctgaattggacaacataaagttttcgcgtccatctactttatcagagaagaaatagtatttaccaacatatccagcatagtagtcattaacgtcagctgtgtgcggatcaactaccaatactttagtatgattgtatttcatatcttgtttggcaatatgattaagttctaccggtaactcttcttttccaattgtgctccgatacttaatcccgttaatttctgagaacatcagaatggttgaaaataaagctaaaactaaggcagataattggtaagtattttttgtaataatatttttgaaacttcgtattccacgtttacttacatcaggctcatacatcgctcggtccatcgctacgacgagtgccatcgtggctaacaacatgtttaaaattaccatactagataaataacgttcagaaccctctaaattaattgcttctgaataaggcattgatacaatatacatcgcaaagacactgagatagtatgcaacaaaactagcatctaaagctagtaggactttgagtaaattattaggtttcttgagatacaagcgaataacaacccacgcgattatcagcgttaaattaaccagtaaaaaacccctagttgatagtgaatccaaactgaaaatttgatgtaaaaacttattaccaatcttcattattacttttgaactttcactagctaattgatttttatatgcagatgtactaatttgatgcttagaaacggtgctaaaagtggcatggacatgctgattccaccagaaaaatgataggtaactccccaccatcgtaagggctgttagacccaaactttttccaaagcgcttaaaccacttaatttctttagagttcttcattaacaaatataataagtaaaaaccaatcataaccacatacatggttccagaatttttaattaaaaataactctgaaccgaacaaaaaggctgtaacacattgcaaccgtggttgatgtcgatacacatagacaccggcaatgccagctgctgcaactaccggaaggataaaatcaactaatagattgttcatccgaatggcaatgttgaacacattaatgagtgaaatggtgagacataaaataaaagcattggttgaccttgtataatctcttaataccgcaaaaacagcataaagtcccgcccaaattagtaaaaattgtcctactaacatcgcaccactactgaatccaacccaagttacaaattgagtgataaataaagccgttgccggaggatatgaagtaaacgaaataattgcatctgaagcaattggtaagtgtccttgtaacaataaatatttaacaattaaagcccagtgggaataattatcatagtgaagcaaaggactgctatataaagtcgttcctagtgaaagtccaatcaaaatcatccacaaatcaaaataatgaaaaccttcaaatggtattttttgaatcttgaagatcgccattaccatacgtaccaagaataaaatacagcccaaaataacaaccgcgcgaagcccaaaccttaaccagtttaacatcgccattatgtatagaagaagggtttggattatcattgaagtaatccatgccatgtatttattaacccctaccattctaattgacccagcataacctagctgagcaattataaaaatgatcaatccgattaacgccaaaaagatccacccaccatttccattctatttaacttatctcttataaagacacttagattattctacatctttaactacaacgtgtcctaaattctttatttttgttatgtaactgtaaagactataaagacggattaaaagttttaaccggctaatttttattgggttaaaggattaagtatctttttttaacagtttccctactttgatatgcttttaaagaattattgttataattgtaaaaaacagaacaaatgttccaattaggagtttatctatgaatttaaataccaatttttcaaattcaattttgtcagcattattagataaaaatatcgctactaaaactgaattcacgccacaactaattgctaatgctccgcacgaaaaattaaagcatcacctggagcaagaattgcgaacctgtacgagttttacttttgctgtagcatttatttctaatgcagtattaaccgatttaaaggtaacctttgctgatttagcccgtcatcacgtttctggaagaattataacttcaacttatttaaattttaatcaacctaaaatttttgcggaactcctaaaaattcccaatgtcgaagtacggatcgccgacgctgatagtgactttcatgccaaaggatacatttttaataagtctgactatcaaacatttttaatcggtagctcaaatttgaccagtaatgccctaattcaaaactatgaatggaatctcaaattatcttcaaaaactgaaggacgtttagctgaacaaatcaatcaagaagttgagaaacaatggcaaaaagcccaaccattaaatcaaaaatggattgatcagtatgccaaattttattcagaaaatgtgtctctatccagccccactactccattccaattggaaaataaatcacctttaacgcctaaccaaatgcaacaagcagcacttaaagctttgattaatttacgttcagaaggtcagaagcgcggattaattatctctgctaccggtactggtaaaacatacttagcagcctttgatgtgcgtaattatcggcctcgtaaatttttattcgtggttcatcgggaacaaattctccgcaaagccttgcttagttttaaaaatgtcctaggcggaccagcggataactacggtatcctcgctggtggaactaaagaaattgaccgaaaatacgtttttgctacgattcaaaccctttctagaccagacattttaaatgaacttaaggctaatacttttgactatattttaattgatgaagctcacaaagctggtgcagcttcctaccagaaaataatcaatcacttcaagcctgaatttctgttagggatgactgccacacctgagcgaacagatgattttaatatatacgaactttttgattatcacattgcttatgaaatccggcttcaggacgccattgaagaaaaaatgttgagtgaatttcattacattggaattactgactatgagtatgagggacaagtcatcacagataatacgcctctgaaacacttagtttctagggagcgcatggattatgtagaacaacaaattgattactacggacatgatggcgatcaggtttatggtctaattttttgtagtagaactgaagaagcccacgaagtagcccaaattatgacgcaaaaagggcatccaaccgttgcactaactggtgaggactctgtggataatcgtgaagcaactatcaaaaagtttgagaacggcgaaatagaataccttgttactgttgatatttttaatgaaggtattgatatacctaaaattaatcaagttattatgcttaggaatacagaatctagcattatctttattcagcaactaggtcgtggcttgcgtaaaagtgaaggtaaggactttgtcaccattattgacttcattggaaattaccagaataattatatgattcctattgcccttactggtgatcaaacgttaaacaaaaatagccttcgtaacaaaatatctattaatcaaacggtcggactttcttctattaattttagtgaaattgcgcgagaacaaatctataattccatcaataatagtaatttgaccctcctcacgaagttacgtgcttcatacatcgacttgaaaaacaaacttggtcgagttcctttactggttgattttcaaaagcacggctctaccaatgctcaaatttttgtggataaatatgagaattatcatcaatttttgtttaaaatgcatgaccagcaggcgttaactacgctcgaggatagctttctgcgcttaatttcgcgagaatttttaaacggcatgcgtgttcatgaattaattttattacaggatttatttactaataatggtaaatattccaaaaatgatttaatcaccgaactaagtcaaatgggcacttatactgatgtggcaactattacctcattggaaaagcatctagacttaacttattatcagcctaatgacagcaaaaaatatggcaatactgccatgataactttggttgaaaatacttaccatttgaatgaatcgatttggaattcatatcaaaataactcctactttaaaaaactagtcgacgacgtaattacaactggattaattaatagtaagaactatgatttgaataccaaatttacactctatcaaaaatacacacgtcgccaagtcaacagcttgttaggctggcctacagaccaatcttccgcaatttacggttataaagaaaaaatgggattttgtcctatgtttgttacttaccagaaacgagcggacatccctgatgagttaaaccataacaacattttctataattcttctttactaagttggtatactaaaagccctcgtcgtcttgactctaatgaagtagttcggctactagaaggtaaccaaaataacacgattgatttactactttttgttaaaaaaagtgacgatgaaggctctgatttttattatttaggacaagttgatttcgattcagattcagtagaacaacaatatcgcaccgttaaaggtaaagaaaaacccattgttaaagctaatttgaagcttcgaactgcagtcaaatatgatttatacttagatttaatcaattaacgttttggagtacaatgttagtagcattaattaaatctttttggaggaaatcagtttgaaaaatgcacataataaaattactttaacgttacttttagggctttgtaccttacttctgggcgcttgtgggcaaaatactaccaataccactagtagtaatactaaaataacagacaactcttcgaacgcaaaaaagcactctactgctaaaagtttttattcaaaaaattctagcaatcaaagttcgagtgtctggaatgataccaaggatgataaattagcttccttcatggttacttggggacaaactatgaaacaaagctatactcaatgtactccagatagaaatacaacatatactggtttacattatcccaacgatttttccgacaataaaactgcttttagcaaccataagctgtctgctggctggtcgccagacggttcaaataaatataaagtaaatgttgtagcaatttatgaagatactaatggtggttcaaccattggcgggcgaatttatctatttaccattcaggatcatactcctattgtctattacactgaacaaaatcaaggaactcccgatggattagttcattttgaacctactcaaaatacagatttaagtaacgaatttaaaaatattgttaatagcaaaaaaacggctactccaaaatctgcaaccactaagtcatctaataaatcaggttcatcagatacaaatgatcaaaaatttgtatttccttcacgaatgcaaggaacttggtatacgtacactgatgaggataaaattcaaaccgtttctttcgatggcaacctttggaaaagtatggggaaaactgacaaagctttcgaggcttcaaaacatccctcagaaattacttacgatgctaatgatactagtaaggataactgggttgttgcgacgtttatggaaagtaatgatggtatctttaaaggagacgaaaattcctctaggatagtaaacatccgaggctggtaccaaggcagtggagatggaacttattactataacactactcaaactgtggacggtaaaaaattgaagtactgacggaagccggtggtgcaatgatagccactactgctcattattataaatctccagcgcttgctaaagaatatgcatcaaatgattactacgctgatcatcatggagatgattaaaatatcaattcaatctaaaaggcttagctgtttttcaacggctaagccttttcaattatttataaaaaattctatttatctaaaggaccttggttaagatatgcactaaccatccaaatccatttatcaacttctgccctaaatccgtttaacatatcttgagtggagaagtcacgttcttcatccgatacttccataccaatccgatactgactggcaagatacttaaattgatcattaaggcgttgcattagctctggtaatgaatattgattccaagttatcttttcgtcgggtaatccggtatgatcaataaattcatgcgttgtagcatatggtgaaccacccagagcaattaaacgttcagcaatttcatcaagttgttcacctaattcttcgttatattcatccatttgaggatgtaatctaaagaattctgatccacgcatataccaatgagtttgctgaatattagtttctaattgactaatatctgcaattaattgattgagttgttccattgttttaggaaattgtgctttatgttctgacattttacatacccctttcaaacttataacttatcatctacgcctacagtgtaaatgaaactgttttctatttcaaagaatatgaattttattctaaaagcttttaaacattagcaatcttctttgtatttctttcagttagacttagtaaaattattccattagtcgccattattctcaaaaagagttttttagttatataaaagtcagttaatcgatagcatgtatttaaaacctatgctatagtgctcttgtagcactatgctgataatttattttttattactattttttatctttatgattttttcaacttctttccgagcaagttcatttaaatcaatatctaaataaaccgatagtgcaaacattgcttttattgacattcgtcttggcaatggagtcaactcatcctcataacgagataacatactagttgatatatcaattccatattcgtcatggattttgcgaattaattcaatttggctcattttacgttcttcacgagcctttcttaaaaccgagctaaaaatcaaggacggaatcctcctttatattcgaatgtttcaatttcagtacatacattttaattaaagcataacaaatattgaaaaggataccctcaagtattataatcccatgttaggaatctctataaggagtatttaaaagtataataggatggtgaaatatatgaatgacgatgctcaagcttcgcaaggagtattaaaacacctaaaagctaagcaaataaaacaagaagacgcggcaaattacctcggtatcagtcgcacgaccttaaatcgaaaattaaatggttcaagtgagtttaaaatttctgaaatcaaattaattcataaacaatacaatgttcctttgagtttatttttcgaagaatagtagatctttaaaaaagtttgtcatagattaatctctagtataatcctatatcaataccccttaaaaaatataaaaatacaattgcagtgatactgtccgaagttattgaaaagtaagtaccccagcttacttccccatctcgaattaacgtatatacttcttttatcactgcaattaataacccccacggatcgatgtgcagcgattcgtgggggttttattgtactaaaaattaaacaaatttgcattataattacaaaacccataatgtcagtcatatcttgtgaactctaattgtaattttactagataacagcaggctaaacttagctatgtttcacttaaaattgcacttaatgagcaagtaactgtttcagaatggcaatggaatttgtactattttcatacgacatatcttaagattgacctctatatcacaacagagatcaatcctttttactacaatctaaaatcagtaaccactagattttagaattaactaataacaaatgatttgatattttttagaatcacgtcttaaacaaaaaacactctcccaaaggaaagtgttttaaacgaaaatataaatattaacgttttgagaatcacctgacgctattcaagcaatctgtgtctgttaaaaatacctttgcttcggtatttagataattagaaaggggatgaagagctatttgtatctaataaagtagattaaattggagtcaagcgtcgccacttgacagatacaaagctactcaaatttttttcatattaaataagctaattcatcctactttttaatagctttaatttcatcttttgcaatcttgttcaaatcgagatccaaatacactgctaaggcaaatatcgccttgattgaaattctacgtggcatctctgctgtttcgtcttcataccgtgacaacatactcgtagatatatcaacacctaactcgtcgtgaattttacgaattaaatcgatttgagtaagctttttctcttggcgtgcattttttaacatcagactaaataacaaaataagttctccatttcttttttgatacaaacgtactttaaaagatacatttgtatccattaaaccactaatgtattttaaaaggaaaatgttctattgataagtaatcgaatcagggttacaattccttacagggaatctctacacgggataaggttgaaaaagaaggtgattttttggatattgataaacaatcttctctcgaagtattaggttatttaaaaactaaacaaattaagcaagaacaggtcgctaaattccttggcattggccggactacattaaatcgaaaattgaatggtcaaagcgattttagaatttctgaagtaaaagcgatgcataaacaatttaatattcccatcgagttattttttaaagaaaattaggaggaaattttagtggaaagcagaacaaataaagttcattttaaaacgtttaaagccggtaaattttggctcgtatctggaattacattagccgcactaggaggaagttttacaatttcaggtgttggcgttcatgccgatgaaattaatggtcaaccagtatccgctgctaaagacacaacgccaactactgacgtctcaactaataaagttgctgaagcgacacccgctcaacaacaagccatcgacgacgctcaaaaagacgttgatcaagacaatagagatatcgctaaaaatcaagatgatactgctaaagaacaagccaacaacgatgatttaaacaaccagacggctaacaaacgagatgatgttaacaaagctcaagatgcatctgataaagctaataatcaagttaataaagatcaagatgctgtagacgatgctacgccagatggctacgatgacgtccaaaatgctaaagatcaagcagaaactgataagaacaaagcccaatcagacgctgataaagctcaagctcaacaagctgctgctgataaagctgctaaagaagcggccgacaaagcagctaaagctcaagctgataaagatgcggctgctaaggccaaagcggatgcacaagctaaagctgatgccgctaagaacaaggctgataatacgccaaagacatctaacgtgcatcatgaccctaccccagctaaaccgggcagtcagcttgatccaactaacattgatagtgaagccgatttacctactgaactggtagaacctagtggcttaactgatgaagaaaagaaccaagaatactatgcctctacagatccttggtataaatataccggtgccaacgatacttcagccgtgattaaagccggtacgcaattgactgctcaacaacaaaaagagttagctcaatacgccctcactttaatcaacagcctacgtaaacaacatggattaaagccaattctgatgtctgatacagtccaagaacttggtaatgctgtggtaaacttacgtgttaaaaatggcactgaagctggtgtgcatacagacactggttcagctgaattagatgatgccattagtaaagtggccggtggtaatcaatacgatgtaatcaacggtggtgaaaacctatatggtagcatcctagaaaatagtgatacgaccttactccaattaaaagttcaacttcttcaattcctcactggtatgtcctttgcggacggtcattggggatggggacatcgtgataacttcttaagtcacacttatggaagtcaagatgaagctgatcaagtctacatgagttttaatcttcaacactacctagacggtggcgacactggtttaaacaccataacttacctattcgacttctgggttgctaagactggtactgacggtacagccgaaaaagctttaagcaatggtgcttatagtgaatacgtcaaccatggttacgattctgtggaaactaacccagcttatacccaagcggttaacgattataaccaagctttagctcaagttgctagtgctaataaggcttacacacaagctaattacaatgctaatagcactgctagtgcttccaagcttgcccaacaaactttagctaatgctaaggctcaacttaaaacggcccaagctaacttagctaatgctaagaccaaattagctaatgccgaaaaagccctcgctgatgctactgcccaatacggcgaccaattaaatgcttataacgctgctaaagcaacgcttgaagctgatcaggctaaagcagcccaattagctaaagaccttgctaacgctaagcaagcacttgctgataatcaatctgcgatcgctacttctgatgctaagatcaagagtttgaaagaccaattagctcaattgcaagctaagctagctaaggacgaaaagactttagccgacgctaaggctgctgccgaaaataatggttcagacactgacaataatggatcagacaataacaattctggctctgataacaacggtggcaattcaaacaccgatccagataacaataattccggatcaaacgataaccataataacggttctgatactgataataatgaatcggataataataattctggttctaatactgataacaatagtgataattcgaacaccaatcaagataccaaccactctcgctccgataatggtggatcaaatgtcaacaatagcggttcagatactaatagcaacgattcagatcatagttttagtaccaattctgagttaactacaaatggtattgatgattccgatattcgagataatgatgctactacaaataacttatctttcgtaaattcacgaaatagtagcacaataacacctgctcaagtagcggcaaagacgattaatcaaaaacaactgccacaaacgggtgatcaaacttcaaatcaagaaatatcattacttggtatgatcggtttagcattatctagcttaggccttatttcaatttcaaagcgtaagcataactaatttaaacctatgattatctaatcatgtaatatccctctagaccggtagtttagagggatttaatttgacaacagatagtaaatataacaaatgcaactaaatcataaattgataaatttcatcattataggtaccaattcaccctatttcaaggagaagaaaaacatggaaaaattaaactcagaatttattaaaaaatacaagaaaataataattggagccattattgttttactcgggataattttttacacatatcatcaacataatcaagttagtcaggttattaaaaatcatacatataaagtaatggttactgggcccgataaatctggagatacagtcaaacagtgtggcgtcttaatttttgctgataacacctataaagaagggagtgacctagatgaagatttctctgatctctccgatttaattgatagtgctcgtgaaaatgattcttcatcatacactgctgctaaaaatagcatcacattgagttccggatattctgatgatactccaagtcatggcgatatagctcatcttaaaaaccttaaaagctcaaaaggcggaaaaattattactggagatattacttataaatacgaggacgatagcgcagtagacgaaaacgcatatgagtacaacaacatcactacgaaaactgctcatgcaacaattcaacttgaacagataaaataactaaggagcttaatctcatgtttaaaaaaatttcacttttactagtaactgggctgagtattcttcttctagcatcttgtaaatcaactgttaatgggaacactgcgaacgattcatctagcagtgctaaaacttcaaagtcacatacttctgaaagtacctcaccttctagttcatcatcttcaagtagtagcgaggaagagtcctctcaagatcaaagtacaaccactagtccccttacttttgatgagggtatgcaaattttgcagcagagcgtatataaggattatataaatgatagtccgcaacttgttagcaatgataatcataaactagttatctcagcttatgctggtgcgaaaggtatcaattactttactctaactctattcggatcaaatcaagttaaaattcatgctgaattcggtactttagatggcggtaaatttactaatcttcatgatgtcgatgcacctgaatatcagactgttactcgtccaaatgctacagcatcaacatcgtctaatgataatgattcttctagtacgatccaaagcgtccctgctaaattcattgggaaatggaagaaaactgattcttttaaaactgaatccgatggtaaaaaatacgaatacgcaaaattatttcatgctacgtctaactccatcctacttggagaaacttacacggattgctacaaatacactgtttcttcttgtaaatcacttggacctaatgattacgcagtagaaactaaagttcctatcaccaacgagtctcaaaccatttatctccattattattcaaaagataaaattggagaaaaatttaactcatcagatgattttacgattttcgatagtagagcaccagttctcaactacgacgcgtctgaatggtaaaaaacaaaacggaggaacacatggaacaacttacagcatttctaaaaaaatataaaaaatgggtcattacaattgcaattctaattgttgctggttttggtgccaaaactacgtacgagtatcatcaaaacaatatcatttcacaaatggacgttaaattttctggttacaatggtgaaggtacagccgaaatcaagaaaaaagataaatttttaaatgatactgctttacgtatcttcaaattgaacggtgtcaggaccgatatcgcaaaaaaaattattagcagtccatctaattttaattatggtagtctttcaacttctgaccaacaaaagattacgcaatccttttctgaattaaattcattaaaagttaaacttagtaaatctgaacatctaaaaaatggagataaaattgacgtttatgttaaaaataatgacccagaacatttaccatttagagatggtaaaaagattgtaaccgttaaaggacttaagaaagctaagacagtttctactcaaaaaatatttgataagttaaaaatcaaagctgtcggtactgatggtaaaggttcactttcaattacaggtaaaaacataactacgagttctgtattcgacggtatagagattgcagttaaaaataatggctctttaagcaacggagatagcgtaaaaatcaaattaccatcttctgtatttaaagatcctaatggtaaaaaagtttacgctggttcacatactcttaactacaaagtcactggtttagtagataagtctatctctaatgtgagcgacgttgaatcagccgtttctgatatgatcgatgattacaatgacggcaacgacgattacactcctaattttgtcagtttgtatctaacacatgacgaagattactacatcggaggtgaggacgacacttctagcgagcatgttactattgatgatgaagatgacgttaaagacgataacacattcacgatcaccgctatttacaatatgaagagtaatgatgcagatcttgatgatgaaacagtcgaagcaatcattcatgatattaagttaaaaaacaacaagttaaacatcgacagtatcgacctttctaaatctggtgaagttacaagtgttgataacactaggactattgaacataacttagcttccgatggcttaaaattaaaataaattctaatgttgcagtaatactgttcgaggtgagaaagtaagccccccaacttacttttcaaaattaatttaattacttctattattactgcaatcaataacccttaattgctgttgtgcagtggcaattaagggcttttttgtgtcaaaaatcaaacatatttacatttatattgcatatcaaacgttttacagtgtaataatttcttgcgtgatataatcttatataaggaatctttaaaaggaattattacatatttactttattacttaaactttttggaggatataaaaattgcgtaaagactatcacgatcaaaagaaccattacaaaatgtataaggctggtaaaaattggctattcgcaggaatcggagtaattacacttgcttctaccgtagctatgactactcctaatgcccatgctgccgagttgaacaatgatactaatctatcatctactcaaaaagatgaacaaaaagtaaccagcgctactcctgctcaacaagctgctattgatgatgctcagaaggatatcgatcaagacaacgccgacatcacacaaaatcaaaagaatacagctgatgaacaagctaatcacgatatattaaccgatcaaacagctggaaaacaatccgatgtagaccaagctcaagctgatgctgataaagctaatgatcaagttgataaagataagagtgccgtcgatgacgctgtccctactgactatcaagataaagaagatgctgaacaacaggctcaaaataacactgataaagcccaagatactgtcaatcaaactactactgataagaatcaagctcaaaaggatgtcgataatgcatctaacaaagctgaccaagcgaaaactgctaaagatgacgctgctaaaaataagaccgatgctcaagatcaagctgatgcagctaagaataaagttgataatacgaacaagacaactaaagttcatcatgacgctacaccagttaaaccaggtacatatgataagggtaatgttatagacagcgaagcaagtctacctgatactttattagatcctaaagatggtcatactgacgatgttgcttactacggttcttcatggtatgtatatgattcaaaaaatgataaatctaagaaaatcgatataaataatttgactcagaatcaaatcaatgaattaggtcaatatgccttaggattaattaatagtcttcgtaaacaatatggcctttcaccaatgattatgagtgataatactcaaaagatggcagccggtgatattgtaatccgtaataaaaacggtattactgatgatcatagtctgattggaaataatatttctcaagccgattggaataagtacacatttgattcaattgctggaaaccatgatggaactaaatttgcggctcaaaacctgggattctttttcggagctgaagatactatgttagcggctaaagtatctgttttacaaatgttaacggctatggcttttgatgatggaccaggtaactatcatcgccaagccattttaatgaacccgaatagtgttgatggtcataatatatatagtgacgaagaagatgtaacttattacttcggatatggacatcaatcttccggcaatgaaagtatctttgatttttggaaagaaaacaactctaatgtatggaatggtggtattgctgtttccacgggctcagatggtcatagttcatttgcttctgaattaatgaagcatcaaaaaaccggttatacgaacaatggtactgatactattgaaaccaaccctgcttacacaaacgctgtcaatgattacaaccaagctttagcccaattaactagtgctaataaagcttataaccaagctaatgatgcttacaacaatgcaacaaacaatttgaacgatgctaagactaacttagctaacgcaactacaaaacttgaaacagctaaatctaatctaaatgatgccaagactaaattagcagacgcaaaacaggctttagctgatgttacaacccaatatgctgatcaattagctgcttataaccaagccaaagctactttgaagaatgaccaagctaaggctaaacaattaaaccaagatttagctaacgctaagaaggctcttgctgataaccaatcatcaatcgctacatctgaagccaaaattgcacaattgcaagatcaattaaaagacttacaagctaaattagctaaagatgaaaagaacttagcagatgctaaagcggctgcagaaaacaatgataattctgatgatactaatactggtgatgctgatatcgacaacaatgattctgacgatactaatactagtgacgatgatacaaatactaacaacagtgaagatacatcagacaccaacaataattctgatagcaacaatcactctgatgatgttgttcctagtcaatctgatacaaaggatttaaataacacagtcgatatcacagaaaatactcaaaataataatgttgaaaatacagcagtagccaataatactaagagttcccctgttactcaaaacgtagtctacaagactaataatcagactgtaactccggcacaagttgctgcaagtacgttcaatcaaagccaactacctcaaacaggtgaaaaccaacaaaacggtaaaatgtctattatcggacttattggcttagccctttccagtctaggattagccaaactatttggacgtaaacacgtctaatactttctataataaaaggatcccttaaattaaatttaaggggtctttttttgtactaccattttaagaccacaaaaaaacactctcccaaaggaaagtgttttgaacgaaaatataaatattaacgttttgagaattgagctgccttacgagctttcttaagaccgtatttcttacgttccttcatacgagggtcacgtgtaagaagaccagctttcttcaaaggtgcacggaaatcaggatcaacatccaaaagtgcacgagcgataccatgacggatagctccagattgtcctgagaatccaccaccattaacgttagcaataacgtcatagttaccgtttgtttcagttacaccaaatggttgtacaactacttgacgtaagtttgcaaatggaatgtattcttcgattggacgatcatttactgtgattttaccggttcccggtacaagacgtacacgagcaacggagtttttacgacggccagtgccgcgatattgtgcttcagccaaaattcaattcctccttaaattaagttcgtgatgtcaagcttttctggattttgagcttgttggttatgttctgaacctgcataaacatgcaacttcaaagcttgcttacgaccaagagtgttgtgtggaagcatacccttaattgatgtttcaatcaaacgttcaggtgtcttttcacgcatttcaccagcagtcttagacttaataccacctggatgtaatgtatggtgatagtaaatcttaccagtagccttacgaccagttaatttaattttttcagcattgataacgataacgaagtcacctgtatccacattaggagtgaatgttggtttgttcttaccacgcaaaatagatgcaactactgttgaaagacgtcccaaaggaatgtctgtagcatcaacgatgtaccatttacgttctacttcacctggtttagccaaatatgttgtacgcacttgaatttcctccaatttctgttttgtttaactcaactttaataagtttccggggcttattttgtggaggtaaacaataccaacttccattatattaacagtccctattaaagtcaatcaaaaatctaataatctacttcttttaaatatagcccgctagcaggtgctgttccccgggcctgatttcggtccttaacttcaaagagacgtggtatatcatctgctggacgacgtttactacctatttcaactaaaactgccaccataattcgaaccatgttgtacaagaagccattgccgtaaaattcaaacacgatttcattttgttttttatcttcccgtactttagctttataaatggttcgaacatgatcttttacggtactccctgatgcaacaaaacttgaaaaatcatgagtaccttctaaatctttaatcgctttttggattaacccaatattaatggggaacttccagtgacctgtataatttcttttaaacgggtctacgaattgtcccaaagccattcgatactgatactttttaccatgtgtggtaaaacgcgcatgaaatgtttcatcgactatttcaaccttttttacttgcatatctaatggtaattgactatttaatgcatgtagcatgcttcgttctgtcatttcaatggataaatcaaaatgaaccacttgtcccaaagcatgtactccagcatctgtacgtcctgatccataaactgaaattttcggggttgggtttttagctattttattaactattctttttaagaccccttccacagttcgctgattaggttgcatttgaaaacctgcaaaattagtcccgtcataggctaatattattttatatcgcattactaactccaatttctgagtaccataatcaatgctacagaagccatcatgaatatcgtacctattatgtcattttttgtataatttaaaactcgatacttactgcggccttcgccaccctggtagccacgagattccatcgctgtagctaattcttcagcccgattaaacgcactttcaaaaagaggaatcaatattgaaactaacttttttaatctggccataattgatcccgaactaaagttagctcctcttgagcgttgagcattcaagattttttctgtctcgtctattaatgttggaacaaatcttaatgcaattgatagcattaacgccatttcataaacaggaaaatgaatctttttaagtggcataaaaagtgactcgattgctcctgatatctctagtggtgatgttgataaagttaataccgttgataccagaataatcaggacaaatcggattgcaatgtaaacagcatttaacagaccatcactcgtgatagataatattccccaatgccaatagacgtgccctccgacgccgaagaagacctgaatcacaacggttaatagaattactccaattaatggtttaacgccgtcccagaagaatttaggggctattcctgatgaagcaatgatagtcaaagcaattataaaactaaccgcatatgctgaccatgaattagccataaaaacagccacaatatagatcaaactcaaaatcaatttagcgcgcggatccattcgatgtacaaatgaggtgccggggacataacgaccaaatagaattttattcatgacttggcctcctatctttgacattaacaatctgatgtactagaccactaatatcaagtggcattttatcaaatttaactcccctatcagctaacttaatggcaaaatttgctgctttaggtaatcctagttgatgttttattagccacttagtgtctcgaaaaacttcaaccggagcaccattcttaacaatctgtcctccatccatcacaatgacattatctgcataatttgccacatcatccatttgatgggttactaatagaatggtaagttgctctttatgatgtaattcattaaaaagttccatcatttcaaatcttccttgagggtctaatccagcggtcggttcatctaaaataaggattttaggattagttgccaacacacctgcaattgctactcttcgcatttgtccaccagaaagttcaaacggtgacttctgccaaaattcttctggtagcttaactttttgtaatgcatctttggctcgattcgtagcttctgtatctgatactccaaagttcaatggcccaaacttaacatcatcaactaccgtttcagcaaaaagttggctttcaggaaattgaaaaacaatccctacatgttggcgtaaggaaactaattgtttatttttagtattagcattaattatttgtccatcgacattgaccaagcccttggttggtcgtaagagtccattaacatgttgaatcagcgtcgacttgccacttcccgtatgaccaataatagcagtatatgatccatcaggaatcgttaaattaatgtttcttaaagatagattttcaaacggagtatgcgcttggtaaacaaaatctacgctttcaaaagcaattgacatagccattcctccaaatcattttcgtccattcgtaattctactggaggatgaattccttgttcgactaaggcatcaaataaatgtgcattaaatggtttttctaaaccggttaactttaacatttcatcatcattaaatacttttttaggagcaccagattcgacgattttaccatcatttaagacaatgacatgatctgatagcatagcctcacttacatcgtgcgttatagaaatgaccgtaatatcattttcctggtgaatttcattaattaaattaattatttcatagcgtccttgaggatcaagcatgcttgtagcttcatctaagataatgatttcaggttttgaagctaacaccccagcgatagctactcgttgcttttgtccaccagataattggtcaggttgtctctctttaaaatctcccattcgaactttttttaagacattattgacaatcttatgcatcttgtcagtttcaatgcctaaattttctaagccaaatgcgacatcatcttcgaccgttgctccaacaaattgattgtcaggattttggaaaatcataccaattttcttacgaatgtcccaaactgtatcatcggataaaataattccatctacattaattacaccctcgttatatgacatcaatccatcaattgaacgtgctaaggtactcttcccactcccattatgcccaacaattgaagtccaactgcccttttcaatagagagcgaaacattatcaagtgcttttttgtcaccactatttgcatatttgtatgtaagattttttacgtcaataatgttattcaaagtctcttatctccctaaacaatatggacttaattctatcattctatacaaaaaaaatcactgaagataatgatagcaagttaaaaactcgccgtgggctagactaggatttctccaacatcgtaacaccctaccattatcttaagtgatagattttgttattattaaaatcgttttaaattaattaatcaactaattctaaaacaaccattggggcaccgtctccacggcgtggcatcgtcttgtagatacgagtatatccacctttacgatcagcataacgtggagctaaatcagcaaacaatttttgaagtgctgaagaaacttttacgtcctcaccatcttcagtaacatcagcaacaacattacgaacgaatgctgcagcttgacgacgtgcatgcaagtcgccacgtttacccaatgtgatcattttttcagtagtagaacgaacttccttagcgcgtgcttcagtagtaacgatcttttcgttaacaattaattctgttgtgagatcgcgaagcaacgctttacgttgggagcttgtacgacctaatttacgataactcatctatgggaaccctccttatgattagtcttctgaacggaaacctaagcccaataaactaagtttctcttggatttcaaccaatgacttacgtccaagattacgaactttcatcatttgagcatcagtgcggtcagttaattcttgaacactgttaatacctgctcgttttaagcaattgtatgaacggaccgaaagatctaattcttcaattgtcatttcaagcattttttccttgtgagtttcttctttttcaaccataatttcagtctctttagcctgatcattaaggttaacaaagattgcaaggtgttctgttaaaattttagcagataaacttgttgcctcactaggagtgatagaaccatcagtccaaatatcgagcgtaagtttatcatagtcgtctcgttgaccaacacgagtattttcaacttgataattaacacgttcaattggggtataaatagaatcgattggtaatacaccgattggcatatcaacctttcgagccttgttttcgtccgcagatgtatatccacggccagtgtcagcagtgagtactgcatggaatgtagtaccttcagctacagtacagattggtaactcaggattaagaatcactacgtcaccgtctcccataatatcgccagcagttacattagcaggtcccgcaacattgatttctaatgttttatcttcatcagattcaatcttcaacgaaaccttcttaagattcaaaataatttgtgttacgtcttctacaacaccttcaatggttgagaattcatgtaagacactatcaatttgaacgctagtaatagctgctcctggcaatgatgataataggatacgacgaagtgaattaccaagcgttgtaccatatccccgttctaagggttcaataacaaatcggccataattgtcattttcgtcaattttatgaatttttggcttctcaaattcgatcattctaatttttacccctttcaaaacgcagtctgcatttcgattttgaatgcattataaagtttgccctcaaacagaaccgaactctatacacgacggcgctttggaggacgagatccattatgaggaactggtgtaacatcacgaattgcacttacttcaagcccagtagcttgtagtgcacgaatagcagcttcacgacctgaaccaggtcccttaacagcaacttcaacattcttcataccatgttccatagctgctttagcagcagcttctgatgccatttgtgcggcaaaaggtgtagacttacgactacccttaaatccaagagcaccagcagatgaccaagcaactgcgttaccttggggatctgtaatcataacaagagtattgttgaatgttgaatggatatgtgctactccagattcaatattcttttttactcgacgtttgcgagtattctttttcgttgccataaaaagttagcctcctttaattatttttttctacctgcgatagaaactttcttacctttacgtgtccgagcgttattcttcgtatgttgtccacgaactggcaacccacgacgatgacgcataccacggtatgaaccgatttcttggagacgcttgatattgagactaactgtacgacgaagatcaccttcaactagatagttatctacttctgcacggatcttgtcttcttgatcggctgttaaatcacgaacgcggatatcttctgatacttctgcgtcctttaagattttttgagcggtagtgttaccaataccgaaaatatatgtcaaaccaatgacaattcgcttgtcacgtggtaaatcaacacctgcaatacgggccattaaatttcacctccaagtataatattattttccttgacgctgtttgtgcttaggatttgctgagcaaattaccataacgcgccctttacgtctaatgattttgcaatgttcacacattgtcttaactgatggacgtaccttcatgaataaatcctcctaaacgaataaaacttatttgaaacgataggtaatgcgacctttggacaagtcgtacggtgacatttcaaccgtaaccttatcgccaggtagaattttgatatagtgcatgcgaatctttcccgaaacatgagcaagaatttcatgaccattttcaagctctactttgaacatcgcattaggcatagtttctttaactgtgccctcaatttcaatgacattatctttagccactaaatttgtgcctcccattaacttttctaatagtaataaccaacaaaaagcctcaaaatatgtatttcgaagctaaacctgaattagcttaccatacgaaaaaactatttgcaaacaatgaacgttatctatagtaccaacaagcacgaaattagagagcctctaatacttttttgacttcagaataaacatcgttgatatcctgatcgccattaatgttgtaaaggagatgcttttcttcatagtaagaaatcaacggagtgttaagtttagtattaacagcaatgcgattttttacagtttctggcttgtcgtcctcacgttggaagaattcgtgatgtccgcaaacatcacaagttccttcaacctttggtggattgtaaagcttatgataagtagctccacaatttttacaaataaatctgccagatagtctttcaaccaaaacttcaggatcaacatgaatgttaatcactgctgtaagtggtttgtttaaacgagatgtcatttcatctagcgccttagcttgatcgatatttctaggaaaaccatcaagcataaaaccatcgttgacatcgtccattgcaagacgatcttcgacgatcccgttagttacactatcgggaacaagttcacccttatcaatgaacttctttgcttccacacccatttcggtttcatttttcatagcttcacggaaaatgtcaccagttgaaatatgtggaattttgaaatcctcaataattctctgagcctgtgtacctttaccagcacctggaagacccatcaaaacgaggtttaatttactcatttgaaattctccttcattgttaaactaacgaattattttcgaatgaatccaacgtattctcgtttcatcattaacccttcaagttgatttgccaactcgattgctacaccaacaacaatcaaaagacttgttccacctaaaccaattgattcgtccaaaccaaaaatgtttgaagcaagcaatggaattaaggcaaccaagccaaggaataatgccccaactacactaagtctaattaaaagacctgacatataatcttgggttttctttcccggccaaacccctggaatataactgccttgtttttgtaaattttcagctagtttttcagggttaacctgaacaaaagcatagaagaacgtaaacaatacaattaacacagtatataagatggcacctttagtggtttgcatattgaatacatcgtttaaaacagtgtaccaagtatcatcagaatgtgatgatgcaaaagccattaaaatggtttgcggtgtagaaataaaagaactagcaaagataactggaataacaccagctacgttaaccttaagaggtaaataactactatcagaagcgccagaagctcttcttgtatattgaattggaattttacgacttgcttgttgtacccatgtaacaaaaattacaatggctaaaactgcaaggataattgctccaacaataataaaactttgcgtccattcgcttttcgcagtattaacaaactgctcagtgtaaatttgctgaatcccaactggtgtacgagcaatgatacctgcaaagataatcattgatactccttgtccaatcccacgttccgtaatcatgtcacctaaccaggtagtcaacatagttccggccgtaagaattaaaccaatcgttagaaaggtttggacacttggtgattcaaccaaattcatctgacttaaataattaaaaccagctgtaattccgattgattgagcaaaagcaaggacgattgttaaccatctcgtagcttgattaagctttcgacgaccaacctcaccttgcttactccattccacaaatttaggaacgatatccatttgtagcaattgtacaataatttgtgctgtgatatatggcgaaacccccattgcgaaaatggagtaattcgttaatccaccaccactgaacgtattcaaaattccaactaatcctgatgaagacatgctttccaatgctttcgcattaacaccaggaacagtgatatatgatcctaaacgaaatacaatcaaaataccgagtgtgaacagaatcttatttctaatatccttcacttttaaagcatttttgacagtcgtcagcattaaatcacctcggttttaccaccagcagcttcgattgcttttacagcactttcagagaatttgttagctttaacagtaagcttcttagtaatttctccattaccaagaaccttaacaccgctaagttgtttactaatgataccagctttaagcaatgattctggtgttacttcagcaccttcatcaaaaacgttaagagcatcaaggtttacaatagcaaattctttacggttgatgtttgtgaatccacgttttggaattcgacggtaaagaggcatttgtccaccttcaaaacctaaacgaactttaccacgtgccttttgacccttttgaccacgaccagcagtcttacctgtaccactagaagtaccacgaccaatacgtttacggttagtgcgtgaaccttcgctaggcattaattcattcaacttcatgcaaggaaacctccaatcttacaaaaattattttacttcttcaacttcaattaaatgtgcaatgtggaaaatagctccacgagttgcctcattgttaggtaggactacagagctatttactcggccaagacctaattccttaacaattgttctttgttttgggaggcgatgtgcagcacttttaattaatgtaacttttaattgtgacatcagaatatcctccttattcagctaaatgatcgactgaaaccccacgaagggcagcaacttcttctgcattacgcatgctcttaagaccttcgaaagtagcacgaacaacgttaacagcagtgtttgaacccaaacgcttacttgtaacatcatcgatacctgctaattccataacggcacgaacagcaccaccagcagctactccagaaccttcaagagctggcttcatcagaattcgtccaccaccgtaaacaccgacggcttcgtgagggagagttgttccaacaataggaacttcaatcaaactcttacgtgcagtttcaaccgctttacggatagcttctggaacttcttgagctttaccagtaccaaaacctacatgaccgttcttgtcaccaacaacgactaaagcagcaaaacgaagacgacgtccacctttaacaacctttgtaacacggttgatggcaactacgcgatcttcaatttccaatttttctggatcgataaatttagacatgtacgtatttccctcctatccttaaaatttaagtccgttttcgcgagcagcttcagctaaagcttgaacgcgaccatgatagatgtatccaccacgatcaaaaacgacattttcaattttcttttcaacagctctcttagcaactaaagcaccaacttgtgatgctaattcagtctttgagccacctgaaatttcgctatctaatgttgaggcactaactagcgttacacccgctacgtcatcaattacttgagcgtagatgtttttgttagaacggtatacatttaagcgtgggcactctgcagtaccagagatttttgaacgaacgcgtgcatgacgacgttgacgttttttgttcttatctggtttagaaatcaaaattttcacctcatattttttgaatctcagctaattatatcaagctgcgtgattatttacctgttttaccttctttacggcgaacatattcaccaacgtaacgaacacctttacctttatatggttctggtgaacgtacggcacggatttcagcagctaaatcaccaacacgttgtttgctgataccactgatattaatgtgtgtgttgtcaggaacttcaaccttaaggtcttcaggagtttccatttcaactgggtttgaataacctaagtttaagattaatgtcttacctttaagttgtgcacggtaaccaacaccaattagttcaagtttcttttcaaaaccatttacaacaccttcaaccatgttgttgaagttagcgcgtgtagtaccatgtaatgcacgcattttattattgtcgtttggacgatcaaatgatacaacgtttccgtcaacggacattgtaatatctgagctcattgtacgtgttaattcacccttaggtcctttaacagttacgacgtttccgtcttgtttaatttcaacaccagctggaatttcaactggttttctaccgatacggctcattgaacggcacctccttatctaaaaattaccagatgtaagctaatacttctccaccgattttcttagcacgtgcttctttatctgtgatgacaccttcagaagttgaaatgattgcgatacctaaaccattcaacaccttaggaacttcgtcagatttaacatatgaacgcaatccaggttttgaaatacgtttcaaaccagagataactcgttcgttgttctttccatattttaggaatacacgaatgatgccttgcttgtcatcttcaatatattcaacatccttgataaaaccttcgttcttaagaatttcggccatatcttttttgatttttgatgcaggtacttctaaagattcgtggcgaaccatgttcgcgttacgaatacgagtaagaaagtctgcaataggatctgtcatagacattcagtattaccctcctttgactctgatttctttttttaccaactagctttcttcataccaggaatttgtccttcatgagctaattcacgaaggcaaatacggcataaatggaatttacggtatacagagtgtggacggccacaacgttcgcaacgtgtgtatgcttgtgtcgagaacttagcaggacgttcactctttacaactaatgattttttagccaatttgtttgctcccttcgcttacttttcaaatggcattccgaattgtgccaatagttcacgtgattcttcatctgtgtttgcagttgtaacgataacaatatctaaaccacgaacacggttaacattatcaaaatcgatttctgggaaaatcaattgttcgcgtacacctaatgtgtagttaccacgaccatcaaaggccttgctacttacaccacggaagtcacgaacacgaggtaatgaaacgttaactaacttatctaagaagtcatacattctttcaccacgtaatgtaaccttagcaccaattgacataccttcacgaagacggaatccagcgattgactttttagcctttgtaacaagtggcttttgacctgaaataagttccaattcagcaactgcttcatctaagttcttagagttagtaactgcatcaccgacacccatattcaaaacgatcttttcaatctttggtacttgcataactgatgtatagtcaaactttttaaccaaatcaggtgtgatttcgttaacgaatttttcttttaaacgatttgccatgaatattatttcctcccttcgcttagattatttgtcgatactctcgccagatttttttgatactcgtactttcttaccatcaacagttttgaagccaacacgtgttggttcatttgtagatggatcgataagcattacatttgaaacatccataggtgcttcaacatcaagaattccaccttgaggatttgcattgttaggcttttgatgttttttaatcatgttaaggccttcaacaacaacacggttctttttagcaagggtttgtttaatagtaccttccttgcctttgtcttttccgctaattacgcgaactttgtcgccaacttttacgaacattaatggcgcacctccttcgttatgatggttgattacaatacttcaggagccaaagaaacgatcttcatgtagtccttgtcacgtaattcacgtgcaactgggccaaagatacgagttccttgagggctcttatcatctttaattaatactgcagcattttcgtcaaatttgatgtatgaaccatcagcacggtgtgcaccttgttttgtacgaacaacaacagcttttacaacgtcaccttttttgacaacgccacctggtgttgcttgtttaacagtagcaacgataatgtcaccaatgtaaccaaatttaacacgggaaccacccaatactttaataaccaacagttcacgtgctccagaattgtcagcaactttcaaacgactctcttgttggatcacagttagtgtcctcccttcaattttgtatcagaatacgaaacatgagctagataataaccgctttttcaacgatatcaagcaaacggaatctctttgtagcagacaaaggtcttgtttccataattgttacgatatcgcccatcttagcagcgttgttttcatcatgtgccttatatttctttgagtactttacacgcttaccgtaaacaggatgtgtcttgtaagtatcgatttggactgtgatagtcttatccatcttgtcagaaactacgcgtccttggtaaacctttcgtgcgttacgttcttcactcattgattaagtcctcccttcgtattcttttacttgtttaattcttgttgacgtagagcagttttgattcgagcaatgttcttacgaacagctttaaggcgagcagtgttttcaagttgacctgtagccaattggaaacgtaggttgaataactcgtccttatactctttttccttattgatcatttcgtcagtggttaattcattaatttctttagccttcatctgattcgccacctacttcctcgcgttcgataatctttgtcttaacaggaagtttcattgctgccaaacgtagagcttcgcgagcaacttcttcaggaacacctgcaacttcaaacataaccttttcgcgttttactggtgcaacccagccttctggagtacctttaccattacccatacgaacacccacacctttagatgtgtatgacttatgagggaaaatcttaatccaaactttaccgccacgtttcatataacgtgtcatagccacacgagcagcttcgatttggcggttagtaatccatgatgaagttaatgcttgtaaaccatattcaccaaaagcaactgttttgccacctttagcagcaccacgcatacgaccacgatgttcgcgacgatgctttactctcttaggtactaacatgcttatttccctccttgttctttagagtttttcttagcgtcccttacttcaggtaaaatttcgccacggtagatccatgtcttaacaccaagttgtccgtatgtagtacgagcttcaacccaagcgtagtccacgtcagcacgaagtgtgtgaagaggaacctttccttctgagtagcgttctacacgagacatgtcagcaccgtttaaacgacctgcaacttgtgttttaatacctttagcacctgagcgcattgagcgttgcattgcttgcttcatagcacgacggaatgcaacacgtccttctagttgagcagcgatgttttcaccaacaagttttgcttcgagatcaggtttcttgatttcgacaatgttgatgtgaacacgtttgccagttaattgatttagttgattacgcaacttttcaacttctgatccacctttaccgataaccatacctggtttagcagtgtgaattgaaatgttaacacgatttgctgcacgttcaatttcaacagtagatacagaagcatcagtaagttgctttgcgataaattcacgaatcttgatatcttcggctaagaactttgaaaagtctttatcagcataccatttagcttgccaatcacgaatgacaccaacacggaatccattaggatttactttttgacccacgcgttatccctcctgtttttctgatactacaactgtaatatgacttgtacgtttgttaattggtgatgcagaacccttagcacgtggacggaaacgttttaacgttggtccttcgttaacaaagactttgctaattaccaaatcttcacgatccaaatcaaagttgttttcagcattcgccactgcagacttcaaaaccttttcaacaacaggtgaagcactacgtggtgtaaattttaaaattgcaaaagcttcagcgacacttttacctctgataagatcgactacgagacgaatcttacgagcggcaatacgaacagtctttgcagttgcctgtgcagatgttacttgttcagccatgattcatcctccttactttccagatgtctttttgtcgtcgccaccgtgaccacggaatgtgcgagttggaacaaattcgccaagcttatgaccaaccatatcatcttggatataaactggaacatgttttctaccatcgtatacagcgattgtgcatccgatgaaacttggaaaaattgttgaacgacgtgaccatgtcttgattactggcttcttgtcttgatctttttgtgcatcgaccttctttagaagatgttcatcagcgaatggtcccttttttaaactacgacccattaatttgacctccttcgaaaactgttctagatgttacctaagcgaccgcgcttacgaccacgaacgataaatttgtttgacttgttatgtttgttacgagtcttcttaccgattgttttcttaccccatggagaaagaggagatggacgaccgataggagccttaccttcaccaccaccatgtggatgatcgttagggttcattacagaaccacgaacatgtggacgttgaccagcgtaacgtgtacgaccagctttaccaacgttaactagttcatgttcttcattaccaacagcaccgattgttgcacggtttgttgcaagaaccatacgaacttcagaagaagcaagacggataagtacatacttaccttctttaccaagtaattgtgctgaagcaccagctgaacgaacaagttgtccacctttacctggttttaattcgatattgtggataacagtaccaacaggaatatccttaagtggtaatgcgttacctactttgatatcagcttctgatccagattgaaccttgtcgccaaccttcaaacctttaggagcaatgatatatgacttaacaccatcagcataaacaagcaaagcaatgttagctgtacggtttggatcatattcaatagcttttactgtagctggtacatcatctttaatacgcttaaagtcgatgatacggtattgacgtttgttaccaccaccacgatggcgaacagtcatacgaccgtagttattacgaccagcagtatggctttgagattccaacaatgacttttctggactcttctttgtgatttcagagtagtccaattgtgtcatgccacgacgggcatttgtagttggtttaaatttcttaatccccacgttgttttcctcctatatttatttattcttcaccaaataattggatttcttttgaatctgcagaaagttgcacgattgccttacgacgcttctttgtgtaaccagcgtaacggccttggcgcttcaacttacctttaacattcataatgttgatcttaataactgtaacttcaaagatctcttcgatagcttttttaacttgagtctttgtagcacgtggatctacatcaaatgtgtaacgtttgtcatcgattaacgccattgatgcttctgtaacaacagggcgtagaataatatcacgtgattccattatgctagagcctcctctacttgagaaagagccttttgtgtaatgacaagtttgtcgctattcataatatctaaaacattgataccttcaggttcaacgatttttacattagataaattacgagcagccaatacagcactttcgttatcttcttcaagaactaatagagcttttttatcaacattaaggttacctaatgattgagcaaagtccttagtctttggagtttcgaacttgaattcatcaacgactacaaggctttcatccaataccttttgtgaaagtactgacttcaatgccaagcgacgcattttcttaggaatgctgtatgcatatgaacgaggagttggtccaaagacaattcctccaccacgccattgtggtgagcgaattgaaccttgacgagcacgtccagtacctttttgacgccatggttttctaccaccaccacgtacagcactacgattctttactgcgtgtgtaccttgacgcatagatgcacgttgcataactactgcttcaaagactacatcgttgttaggttcgataccgaaaatatcggcatttaattcaacgtcaccatttttagttccgtcttgtttgaataatgatacgttagccatttatatggtcctcctctcttatttagtattctttacagtacttttaacaactaagtatgacttcttagcgccaggtacattacccttaactagtaatacgttgttttctgtatctgctttaacgatttcaagatgttgaattgttactgttttgttacccatgcgacctggtaatttctttcctgggaatacgcggttaataactgccccaagtgaaccaggacgacggtgataacgagaaccgtgcgccatcggaccacgacgttgaccgtcttttttgataacaccttggaaaccatgtcccttagtagtaccagttacgtcgacgatttcgcctgcttcaaaaatgtcagctgcgattgtgtctccaactttgacgtccccaagctcaacatttctgatttcgtgaatgaagcgcttaggatttgtatttgcttttgctacgtggccttgttcaggtttgttgctcaaaacttgacgtttgtcgtcaaaacctaattgaactgatgaataaccatcattttcaactgtcttgagttgtaatacaacgttaggagttgtatcgattactgtaacaggaattaattctccagcttcagtaaaaacctgtgtcattccgacctttttacctaagattccttttgtggtcattagtacacctccgtttatactttaaattatagtttgatttcgatatctacaccacttggcaagtcaagcttcatcaatgaatccactgtctttggtgttgggttaacgatatcgatcaatcgtttgtgcgtacgcatttcgaactgttcacgagccttcttaaacttatgtggagaactcaaaacagtatatactgtgcgttctgttggcaatgggattggacccgaaattgttgcaccagtacgttttgctgtttcaacaatcttgtcagcagattgatctaagatacggtgttcgtatgcctttaggcggatacgaattttttgttttgccattgtgttacctccttcgtctattttaaaaataagacttgctccgtgaaaattaccgccacaccctgtggcaaagcggccgggtgtgtcgcaacctttcacatcaacgctatgcttatacaccaccgtttagagagcataatgctccctcgtttgaaaacggtacttgataataatacatgataatcagcgttatgacaagggttttgagaaataaatttaaaataaaaagaagttttctccttcaattaaataattgaaaaaagaaaacttctttaattttaaagattattcagcatgtccgccatttttcttgataatttcttcttgaattgattttggaacagcttcgtaatgatcaaatgtcatagtaaatgtaccacgaccttgtgatgctgaacgaagtgttgtagcataaccgaacatttctgatagaggaacaaatgcatggatttcttcagcaccagcaattgcttccataccatcaacgcgtccacgacgtgcagtaacttgtcccatgatatcacccatgtattcttcaggaacacggatttctaccttcataattggttctaggataacaggagcagcagtcttagcagcagcacgtaaagcaagtgatgcagccaccttaaatgcagcttcactagaatcgacatcatgataactaccatcatatagtttagccttaacatcaaccaatggatatccggcaagaacaccattgttcatagcttctctcaaaccttcttcaactgatggaatgtattcacgaggaactacaccaccaacgatggcatcttcgaattcaaagcctttaccttcttcgtttggttcgaattcaacccaaacgtcaccatattgacctttaccaccagactgacgtacaaatttaccttgtgcggaagtcttcttagtaaatgcttcacggtatgatacttgaggagcaccaattgtagcttcaacgttaaattcacgtttcatacggtcaacaatgatatcaaggtgaagttcacccattccggcaataacagtttcacctgtttcagggtttgtttctgcacggaatgaagggtcttcttcagcaagtttttgaagagcgatatccatcttatcttggtcagcttttgacttaggttcaacagcaacttcgataactggatctgggaataccattgattccaattgtaatggatgtgctggatcagtcaatgaatcaccagttgtagtgttcttaagaccgatagcagcagcgatatctccagagaatacttctgggatttcttgacgttggttagaatgcatttgtagcaaacgaccaacacgttcacgcttgccctttgtggcgttaagaacatatgatcctgattccaatgtaccttggtatacacggataaatgttaaacgaccaacgaatgggtcagtagcaactttaaatgctaaagcagcgaatgacttgtcatcaccagcaatcaattcaacttggtcgcctgtttcaggatctgtagcactataaggcttaacatccaatggtgatggtaagtaatcaacaacggcatcaagcatcatttgaacacccttgttcttaaatgctgaaccagcaagaactgggaataattcaagagctaaagtacctttacgaatagcagctttgatttcagcaactgagatatcttctccaccaaggtatttttccatgatgttttcatcaatatcagccaattgttcaatcatttcgttacgacgcttttcagcttcttctttgtattcatcaggaacatcaacagtttcccattctgtacctaattcatcaacgtcatacaaatcagccttcatttcaaccaagtcaataattccttggaaatcatcttcagcaccgattggcatttgaattggcaaagcgttagcttgcaaacggtcgtggattgattgaactgagaaatcaaaatcagcaccaagcttatccatcttgttagcaaaaacgatccgtggaacatcataatctgaagcttgacgccaaacagtttctgtttgaggttcaacaccagcttgagcatcaagaaccgctacggcaccatcaagcacacggagtgaacgttcaacttcgattgtgaaatcaacgtgtcctggtgtatcgatgatattgatacggtggttcttccatgctgctgttgttgcagcagatgtaattgtaataccacgttcctgttcttgggccatccagtccatttgtgaagcaccttcatgtgtttcaccaatcttgtggatcttacctgtatagtacaagatacgttctgtagttgttgttttaccagcatcaatatgagccatgataccgatattacgagttctttctagaggaaactcacgtttgttagccattatataaaaggttctccttccaaatgaaatcaaagtaatagctgtttttagaaaaaatgactactatatgcatccatataatagtcatcatggttgcaatgattaattgcaacgactgaatcttaccaacggtaatgtgcgaatgcacggttggcttcagccatcttatgtgtgtcttcacgtttcttaacagatgcaccagtattgttagctgcatccataatttcacgagcaagacgttctggcattgtgtgttcaccacggagacgagcgtagttaactaaccaacgtaaaccaagtgttgtacgacgatctggacgtacttcaattggaacttggtagttagaaccaccaacacgacgagccttaacttcaaggacaggcatgatgttgttcatagcttcttcgaaaactcctgttggttctgaaccagtttctttttcgataatatcaaaagcattgtataaaatctttgaagctttaccacgcttaccatctaacattaaacggttgattaaacgtgtaacaagctttgagttataaattggatctggtaatacttcgcgttttggtgctggaccttttcttggcatttatacacaacctccttacttcttaggtttctttgtaccgtatttagaacggctttgtttacgatcagtaacacctgctgtatcaagcgcaccacgaatgacatggtaacgaacaccaggtaaatcctttacacgaccaccacggatcaagacaacactatgttcttgaaggttgtgaccaataccaggaatataagctgtaacttcaatcaagtttgacaaacgtacacgagcgtacttacgtaaagctgagttaggcttcttaggtgtcattgtaccaacacgtgtagcaactccacgtttttgaggagctgggttgttaacttgagacttcttcatgctgttatagccgtagttcaaagctggagcttttgacttcgagctttgtgaacgacgacccttacgaaccaattggttaattgtaggcatcgatgtttctccttccaatatatgaaaataaataagtattctttaagtacacatatccaggcggttctttttttgatataaaaaaagacggccgagacttgtaccagggctaacgtttccagtcagcatgtctgcatttgcagaaaacctgtccacaaaaagcaccttaaatagaatatcacgcaatttttatgaatgcaagtaaattaagcaaaaaaacggagcgttatttcgtatattatctaataccaatcattaagttaaggagaaataacatgctcttattttattatttacttataggaattctaggtgccagttggggatcatttcttctagtgctttatgaacgccgtttagtcggtcaatccatcatttttccaccctcccactgttcaaactgttctactccactgccgtattattgcttatttccaattgttagttattggagttgccgagggcgatgcattttttgcgacgtatcgattcctacctactccgtgatgcttgaaatattgtcagccttattctttttaacgatcgtgcctaccacttcgccaacaccatttagttttatttgcttttttatcctcagttacctagccgtggaggatgtagccgttcaatcagttagcacgcatattttaatttttccagcctacttattggtcaaatttaatttttcttggttaaacttcgctattttactcatattaacctttttattattcaataatttagaacacctagcttgctttcaaaaaataggacaaggcgatatagaaatcttattatttttcactttattagttggtgcccatttgactaccctcattattttgattgctgctacccttggagcaaccgtactattttttactaaaaaaagcataattccttttattccataccttttcactgcatattatttattaatgtttgtatttcagtaaaaatcattaatatacttcgcgaaaatcattttataaacacaacatacgaactttatgctatcattactttaataaatttgggaggtcctactttgcaaaatatttattttaatcatgatggtaatgtcgacgatcttgtatctttacttctactattggaatttccagatacaaagttaattggagtgggggcagttggagcagattcctatgtagaacctgccgtttcagcatctagaaaaatcattgatctttttggtcaagatactaccctagaagttgctaaatctaattcacgcccagtaaatcaattcccaaaagaatggcgcctcagcgctttttcatttgatgattttcccattttaaacgaacacttggataacaataatcaacctaaaactaaattggcatctcagccggctcatttagatatgttagagaagattaaagcttctcagcagaaggtgactttgattatgactggtccattaactgatctggctcgtgccatcgaaatcgatcctacaattgtggacaatatcgatgaactattctggatgggtggatcaatgaacggggttggtaatgttgctgaacccgaacatgatggtacagctgaatggaatgcatactgggatcctcaagctgtcaaaaccgtctttgatacggacctaaagattaccattgttagtttagatagtactaaccaagttcctttgactaaagctttacgtattcgttgggctaagcagcgccaattccctgctttagatttaattggtcaaggttattctctagttcactcttttgaagctaactcaacttattatttatgggatgttctaactactcttgtaagtaaatatcctgaattagttgatagtaaaccaattaaagctgctgttatcaccgatggtccctcggctggaaaaacttttgttactgataacggacgtcctttaaccttcgttactcaagtaaattccgctctcttctttgataaattcgatgagctagcgcaagcagctaaaaccaactattaattcatcgcgtttcttaaaattaccataataaaaaagctcaccaaactgtgttatccacaatttggtgagctttttatctaaaaactattattcaacagtttcattcatttctttttcaacgtcacttaatgattggggttgttcaacgtttccgcccacaacttcaggcttgatttgacgataatccgtcataccagtacctgcaggaataatcttaccaatgataacattttccttcaaaccaacaagtggatcattcttaccacgaatagcagcatcagtaagaactcgagttgtttcctggaatgaagcagctgacaagaaactatttgtttcaagagcagccttagtaataccaagaattacaggacgtgatgtggcaggaataccaccagcaatcaaggtcttgtagttatcattcttaaagtcattaatatccattaatgtacctggaagaatgtcagtatcaccaggatccattacccgaaccttacgaagcatttgacgaatcatgatttcaacgtgcttatcactgatttcaataccttgcatacggtaaactttttgaatttcacttagcaagtaattttcagtagaaagaacgtcgcgaactttgattaattccttaggatcgattgaaccttcgttcaatgctgaaccacggtggatgtagtcaccttctgcaaccttcatacgagccgtgattggtaatgtgtaagtacgagtatcggtttcacccttaatcgtaatatcctttgtaccttcagcaggatcttcttcaatagcttcgactgtaccagtaacttctgaaatctcggctggtcctttaggattacgagattcaacaatttcttggatacgtggaagaccttgagtgatatcggcattaccagccacaccaccagtatggaagttacgcatagtaagctgagtaccaggttcaccaattgattgagcagcaacagtaccaactgcttcaccaacttcaacacggtcaccagtagccatattacgtccataacacttctcacaaacaccatgcgcagtgttacatgtaaatgctgaacgaatagttacttcttgaacgccggcttcaatgatttgttgtgctatagcttcgttaatcatctcatttggtccaatgatggtttcaccattttcaggattgaaaacagatttcattgtgtaacgacctaagattcgatcataaagtggttcaatcatttcattaccttcagcaattgctgaaatcaataatccacgatcagttccacaatctttttcacgaacgataacatcttgagcaacatcaacaagacgacgagtcaagtaaccagagttagcggtcttcaaggcggtatcggtcatacctttacgagcaccatgagtagaaataaacatttccaaaacactaagtccttcacggaagttagaaagaattggaagttccatgattttaccattaggagcggccatcaaaccacgcataccagcaagctgagtaaagttagaaatattaccacgcgcaccggaatcagacatcatgaagattgggttttgtggatcaaatgtttccatcagtctttgttggatgtcatctttagcatcgttccaaattccaattacccgttcataacgttcgtcatcagtaataagtccacgacggaattgctttgtaacagtagcaacttgtttatgagctgcagcaataatttctggcttttcaggcaagttagtaatatctgcaatacccacagttaaacctgaaagggttgagcgatagaatcctaagtctttcattcgatcaagtaataatgaagtttcagtaactttatattgcttgtaaacttcagcgataacgtcactcaagaatccagatttgaatggtgcaattaatggtcgttgatttagttgttcacggatgtcttcgccactttcgaggaagtattcatccggtgtaccactaaccaagttttcattagttggagcattcaagtaaacaaagcccttaggaagaatgtcattgaataacattttaccaacagtagtaatcaagatttgtttacgttgtgcatcagtaaatggcttttcaggcattgaattagcacgaacaccaattcttgtatgaattgaaacataaccattttgaagagctaaacgaacttcatcaaggtcgttgaagatcatgccttcaccgacactttcagctcgttccattgttaaccaatagttaccaataaccatatcttgagatggagtaacaactggcttaccatccttaggagcaaggatatggtgagcagctaacatcaaaaggcgggcttcagcttgagcttcatttgataaaggtaaatgaatagccatttggtccccatcaaaatcggcattgtaagcttcacaagctaatggatgtaaacgcatggccttaccacttactagaacgggttcaaaagcttgaataccaagtctatgaagtgtaggggcacggttcaaaagaactggatgttctttgataacatcttcaagaacatcataaacatcatcatctttacgatcaattttacgtttagcattcttgatgttagaagctaagccacgaccaacgagttccttcataataaatggcttgaataattccattgccattggaactggaagacccatttggttcatcttcaatgaaggaccaacatcaataactgaacgtccagaataatcaacacgtttacccagcaagttttgacggaaacgtccttgcttacctttaagcatgtgtgacaatgacttcaaaggacggttaccaggtccagcaacaggacgaccacgacgaccattatcaatcaaagcgtcaaccgcttcttgaagcatccgcttttcgttttgaacaataattccaggtgcatttaaatctaacaatcgtttcaaacggttgttacggttaattacacgacgatataaatcattcaaatctgatgtagcaaaacgaccaccatccaattgaaccatcggacgtaaatcaggtggaatgactggaatagcatcgagtaccatccattctgggtggttaccagatttaaggaaggcttcaataatgtctagacgacgaaccgcacgggtacgcttttgaccagaagcttccttcaattcttctttcaattggttagcttctttttcaagatctactgtttcaagtaaagcttggatagcttccccaccaattttagctacaaatttatcaccatattcacttaacttattacgatattcgcgttcagttaatagttgtttcttttctagtggagtttcaccagcatcgataacaacgtatgaagcaaagtagatgatttcttccaatgagcgaggactcatatcaagaactagtcccatacgactagggattcccttgaagtaccagatgtgtgttactggtgcagcaagttcgatatgacccatacgttcacgacgaaccttagattttgtaacttcaacaccacaacgatcacagacgattcccttataacggatacgtttgtactttccacaagcacattcgtaatctttggttggtccaaagattcgttcgtcgaataatccatctttttctggttttaaagttcgatagttaatggtttcaggttttttaacttcaccatatgaccacatacggatcttatcaggagaagctaaaccgatttgcatactttcgaatttattaacatcgatcaacggactgacctcctctttcttttaagtaattagttttgattgtttttagtttcaacaggagctgattccgttgatggagcctttgcttcttcagcgctagcatttgttttttcgttttgcttttcagcatacttgctaagagcatcgacattcacaacatcgtcatcttcttcgtccatatcacgaagttcaacttcttggtcatccccacctagaaccttcatatcaagtcctaaagcttgtaattctttaacaagaactcggaatgattctggaacacctgggcgtggaattggttcacccttaacgatcgcttcgtatgtcttaactcgaccaacgacgtcatcagacttgtaagtaaggatttcttgaagagtatatgcagcaccgtaagcttcaagagcccaaacttccatttcaccaaaacgctgtccaccaaattgtgctttaccaccaagtggttgttgtgtaacaagtgagtaaggtccaattgaacgagcatgaatcttatcatcaaccatgtgagcaagtttcatatagtgcatgacaccaacagcaacacgttgttcgaatggttcaccagtacgtccatcataaagcacagacttagcatcagaatccataccagcttcagcaactgcttcccaaatatctttatcttgggctccatcaaaaacaggagttgtcatgtggatacctaagttacgtgcagccattcccaaatgaagttcaagaacttgtccgatattcatacgagaaggcacacccattgggctaagcataatgtcaattggagttccatcaggcatgtaaggcatatcttcttgtgggataaccactgaaacagtacctttgttaccatgacgtccggccatcttatcaccaacttggagtttacgcttttgagcgatataaacacgaaccatcatgtttacaccaggtgataattcgtcaccattttcacgggtgaaaatcttaacgtcttgaacgattccgccgccaccatgtggaacacggagtgatgtatcacgaacttcacgagctttttcaccgaaaatagcatgaagcaagcgctcttcagcagataattctgtaacccccttaggagtaaccttaccaaccaagatgtcaccatcttcaacttcagcaccaactcgaacaataccatcttgatcaagattgcgaagggcatcttcaccaatattaggaatttcacgagtcatttcttcaggtccaagttttgtatcacgtgcttctgattcatattcttcgatatgaattgatgtatatacgtcatcacgaactaaacgttcattaatcgcaatcgcatcttcgaagttataaccttgccatgtcatgaaggcaatcaatgggttttgtccaagggctaattcgccttgttccattgatggaccatcagctagtacttcatccgcgtcaactttatcattaactcgaacaattgggcgttggttgtagttcttaccaccatttgaacggcggaacttcatgagcttgtaagtatcaagtgcgccatcatcacgacggacacgtacttcacgtgcatcaacatattcaactacaccagcgtgttgacataaaagagcaaccccagaatcatgcgcagctttatattcaataccagtaccaattaatggagaatgtggatcaaccaatggaacagcctgacgttgcatattagcacccatcaaggcacggttagaatcatcattttccaagaaaggaatacatgctgtagcaacagcaactacttgcttaggagaaacgtccatgtaatcgacattttcaatgctagtttcgatgttatcactttcatgacgagccataactacgtcgtcagcaaatgaaccatcatcattaagtggagagttagcctgagcaataacaaattgatcttcttcgtcagcagttaagtaatcaatacgatctgtaactttatgatcttcccatgaaacacgacgatatggtgtttcgataaaaccataacggttgatcttaccatatgaagccaagttattaatcaaaccgatattaggaccttcgggagtttcaatcggacacatacgaccataatgcgtatagtgaacgtctcgaacttcatatccggcacgatcacgagtcaaaccaccaggtccaagtgctgatagacgacgcttatgtgataattcaccaagcgggttagtctgatccatgaattgtgacaattgtgaagaaccaaagaattctttagttgcagcaactactggacgaatgttaatcaattgttgtggtgtaactgtttcagcatcttggattgacatacgttcacgtactacacgttccatacgtgataaaccaatgcggaattggttttgaagtagttcaccaactgaacggattcgacggttacccaaatgatcaatatcatctgtactaccaattccatcttgaagaaggaagaagtaattcattgaagcgataatatcagcaggtgtgatgtgcttcaatttagcatcgatattaccattaccaatcatattcaatgtacgttctgggtcgttagggtcttgaactttgataacttggatagtcattggttcagtaacgactgcttcttcagatggttggtatgtaaccatcttgaagtcaggacgatcaaggaaaactgctaatttcttcattacgtctttgttgaccatttcacccttttgagcaataacttcccctgtatcaggatcagctaatgtttcagctagggtttgacctaaaagacgagtcttaaggctaagttttttatttactttgtaacgacctactggagccatgtcgtaacgttttggatcaaagaagcgcgcagttagcaaacttcttgaactatctgcagtcttaggttcaccaggacgcaaacgttcgtaaatatccttcaatgattcagcaacccgtgaatcttcgggattcttatgaacatctttatcaagagtgaaatctaaactatcagaaccaccaaaaatatcgatgatttcttcatcagagccaaatccaagggcacgaactaattcggtcattggaatcttacgagtacgatcaatccgtacataagaaatttctttagcatctgtttcatattctaaccaagccccacggttaggaataacggttgttccccaaattttacgattatttttatctgtatctaagttgtaatagacaccaggtgaacgaactaattgtgaaacaataacacgttctgctccattaataatgaaagtaccttgttctgtcattaatgggaaatcaccaaagaatacgtcttgtgatttaatttcgccagtttcgtggtttgttaaacgtaaagttacgtgcaatggtgcagaatagtttgcttcatgttcacgagcttcgtcaaccgtgtactttggttctagtagttgataatcgacgaattcaagtgataatttacctgcaaaatcttcaatcggcataatgtcattgaacatttcacggagaccttcgtctaagaaccattggtacgaatcagattgaatctcgatcaaattaggtagatcaagcacttctttaattcgtgcatagctccggcgcgtacgatgtttaccatacttaactaaatgtcctgccaagttattcacctctccaatttctaaacgagttaaatgttacagtttgattacaatttgcactgaaacctgttttttagcaaaaaaaaaccaaaaatagtcctctataagaaactatttttgcttttttatctagaacactgcggacaatagatcgcactgtctcatttaaccctgctttaacatacatattacattttattccttgccatatgctttgtcaaacaacttgcaatgttaaattatttattttttattaatgttttatttttaacttttaaattaatttttccgttgcgcgctccgatcgtaatatcgtcaccaaccttagcttcaccggacaacattaattcacttaattggtcttcaaccttagtttgtaaggctcgacgcaatggacgtgccccatattcaggatcaaatccagcttcagccaccacatcaattgcactaggagtaaacttggcattaattccctgctcactcatccgctgaatgacatctttagccatcaatttaacgatttgatggagttcaggtttcgttaatgaatggaaaataatggtttcgtcaatccgattgaggaattcgggacggaaactctgcttcaaaacttcacgtactttatctgccatagcatggtaatcttcagctgcattttgagcaccaaagccgactgatttttcatccctcaatgctgtagctcccaagttagacgtcataatgataatagtatttctaaaatcaactcgtcggcccttagaatcagttagaaaaccatcatcaaaaacttgaagtaacaaattaaagacatctggatgagctttttctacttcatcaaataaaacaactgagtatggtttccgacgaacctgttcagtcaattgtccaccctcgtcgtaacccacataacctggtgctgatccaactagacgactagtgctgtaacgttccatatactcagacatatcaattctgatcatattatcttccgaaccaaacataatatctgctaaagacttagccagttctgttttaccaacccctgtaggaccaaggaacataaaagaaccaattggtcgcttagggctcttcaaacctgaacgcgcacggcgaatagctcgagctactgacgaaacggcttcttcttgaccaattactcgttcgtgcaaagttttctctaaattaatcaagcgatctgactcagattgtttcatctgcgttaaaggtacaccagtccaatctgaaacgatttgcgcaatatcttcgccattttcaattaatttataatcttttttagcttcattggtttctgggttattttcagcacgctcaatcttacggcgtaacttcatttctttcttacggatgtcggcagccttttcgaaatcttgattatcaatcgcttcttctttagctgttcgtaatttttctaatcgatcttcatccgtaacttttttcacttgcttctcagaggcatcgattcgaattttagcagccgcttcatcgattaaatcgatggccttatcgggaagaaaacggtctgcaatataacgtgatgataaagtaactgcttgttgaatggcatcatctgaaattttaacttggtgatgttcttcatacttaggacgaattcctcttaaaatttgaactgcttcagcttccgtaggttcatcaacttccactttagcaaaacgtcgttccaaagcagcatcagcttcgatatacttttggtattctgttaaagtagttgcaccaatcgtttgtagctcaccacgagctaaagctggttttaggatattagaagcgtcaatggctccctcagccccgccagctccaattaacgtgtgtaactcatcaataaagacaatcacttgaccatcattacgaatttcttcaatcatcttttttaaacgatcttcaaattcaccacggtacttagttcccgccactaaagaacccatctctagcatcattaatcgtttattttgcatatcagttggaacatcttgatcgataatcttttgagctaatccttcggcaatcgccgtcttaccaactcctggttcaccaatcaatactggattgttcttagtccgtcggcttaaaatttggattacgcgacgaacttcttttgtccgccccaccactggatcaatttttccttcagcagccatcgccgtcaagtctcgtgcaactgaatctaaagttggggttccttcagcacttgtagcccgttgcttactacgtcgattttgagtagctggatttacacctaatttacgtaaagtaactttgcgaacctcggcaatatctgtatccaacgccaataaaattcttgaagacaaaatattatcattttgcactaaagcaagtaataaatgttcggttccaattttaatagcgtttaattgcttagcctgctcttgagcgttgactaaaatttcactagcttttggtgaatatggtaaataatcatcttttactgttcgtaagttaccatagccggtaaattgctcaatttcctcagcaacgtccacttctgtaacattgaattgtcctaagacgcttcgcgctacaccattagtctcaattgccaatgctaacaacaggtgttcagtacccaccgcggggtgtttaaatctttttgcttgttcttgagcaataaccaaggcattccttgcactaggggtaaataaattttccattttccacctgtctttctctaatctctactattcatatctgagatgattcaaaattccaatcatcacttttgctctaatttgttcttctaaattacgatcgccaatatttaaagtacttttggaaagggtcgaggctaataagctcgcttctcgtttacttagtacggagtcttcatataaactgcctagaattgaaatcgcatcacgttcattcaatgaatctccaattacccgtattaaagaatccaaaacatcaatatcgtcaagaagtttaactttttcaattctaatgtatccaccgccaccacgcttactttcaaccacgtaaccattttgaatggtgaatctagtcttaattacataattaatctgagatggtacgacatcgaattgatcggcaatttcagaacggcgaatttcaatctcctctgaattagccaagatttcctttaaataccgctcaattatatctgaaatattctgtccttgcataacgaccacctttctatactctgactaatgttgactattattatacgagactgacagaaaattgcaaaaaatattaattattccgccttaaagctatcaaaaccttaagaaaataaaaaaacttaccatcaattaaacatcaataataagtttattcttgacctatctcaatcgggaaaacaagatttgaacttgcgacccccacgccccgaacgtggtgctctaccaagctgagctacttcccgccaaccattatattctagcacaaatttaaaccggtgatttagaaaacaaaaaaagcattaatcatatccgattaatacttttttaagcgatgcacccagcaggagtcgaacctgcaaccttctgattcgtagtcagacactctatccagttgcgctatgggtgcaaaatattaaatttggtacaaagcggaagacgggattcgaacccgcgacccccaccatggcaaggtgatgttctaccactgaactacttccgcaaaatgccgactagaggattcgaacctccgaccccctgtttacaagacagatgctctgccagctgagctaagtcggcttaaaattgatatgcgggcgaagggattcgaacccccacaccttgcgatacaagaacctaaatcttgcgcgtctgccagttccgccacgcccgcaaataattctattttattagaccattgagaatcgcttctcaatggaggatacagggctcgaacctgtgacctcctgcttgtaaggcagatgctctcccaactgagctaatcctccataaatctctcgtgaacacatttatatataatacggataaaactccgttatgtcaatcacttttgcaaaaaaaattaaatttttctttattaatttttttaatagctttaaatcaccctttttctaccatatttactgaaaaatatttctaatcagagatttatcctttatggattccataaaaaaataagaggcctcagtggggtctcttatttttagataactatttactttttaccaattacagttgtcccttgcatataaggtactaaagcttccggaacgttgactgttccatcttcattttgatagttttctaaaattgcagctactgtacgtccgaccgccaaaccagatccatttagggtgtgtacgtattgcaacttaccattttcatcgcggaaacgaatatgtgcacgacgagcttggaaatcagtacagtttgaacaacttgaaatttcgcggtatttatcttgagctggaatccacacttcaagatcgtaagtcttggctgccgtaaaactcatatccccagtggttagggtaatcactcgataaggcaatcccaatttttgaagaagggtttcagcatgggtagttaatttttctaattcattccatgattgttctggcttagcaatcttgaccatttctaccttattaaattgatgcatacgaatcaaaccacgtgtatctcgtccggcacttcctgcttctgaacggaatgctggtgataatgctgttacgctaattggtaacttttcttcatcaatgatttcatcacgatagtaatttaccaaaggtacttcagctgtaggaattaaagttagtccttcatcttttacttcataaccggcatgggtttctttaaactttggaaattgaccagttccaaacattgatgcatcgttaaccatgtaaggtgtgatttcttctgtaaagccagctgcattattttgatctaaaaagaaattgtaaactgctcgttcaagacgagctccatccccaacgtagtatacaaaacgactaccagcaactttagcagctcgttcgaagtctaagattcctaattcttctccaatttcccagtgagccttaggcgtaaagtcaaaagtccgtggtgttccattacgacgttgttcaacactaccctcttcagttaaactaaccggtacatcttcatgtggtagattaggcagatgagcagctttgctttcaacttcttcggcaatattttccagttgttcgtctaagcctttaatatcttggctcactttacgcatttcttgaattttatcgttagcgtcttctttattacgttttaattgtgaaatttgatcagacacttcattacgaagctttttcaaattttcactctttacaatcaattcacggcgttcattatccttagccaataaatcgtcgattgcttcaggttctacaccccgagttgctaatttagctttgacgtcttctacatgattacgaatcattttcaaatctaacataattacatcctccttaaatatagaaaaagagcctctatccacattgggacgaagagactcttttcgcggtaccacccaagttcacctgcttatataagcggtgcactcaatccgacgataacggaatcaccgtgtggcattacccaccttttaactagcgccggagtttcggctaatcctttccaccatgcggatctctctgaaaacctactttaaacgcctttaatttctctattaatttataaactaattctacaaaaaagccgggtagatatcaattaaattgtggcaatcttttcatcaattagttgaataactttttgacgagcttctggattttccacaaaatcatatttatcaccgtcaattttaattttagcactttgatcataattatcgaaccaagcaacatagcgcttattgagttcgtgatagtattcgtataatgatggatcattttcgatttgttcgaatgaacgaccgcgctttttgatccgttttaacattgtatcaaacgaaatatcaatatgaactagtaaatcgggattcttcttatatgaaagacgtggcaactcttgcatcatatttttaagtaacgaatcgtaaatatccacttctgtattagttgctcgtcctaaatcagcgttcaaatggaacaaaagtgaatcttcataaatcgaacggtccataacactacgagcatcgctattagcttgcttgatactatccatacgtttattcaaaaagtaaatttgaagtaagaacgcatagcgtttaggatctttgtagaaaagtggcaaaattttattatcatctactgattcgtaataagcatcactttcccagtgacttgttaataattctgtaagtgttgtctttcctgcgccaattgggcctgataaagcaatcattataagaaatacctcttttttcgttttttagcactacatattgtaccaccaaacgaccccaaaacaatatcttgaaaaaattattctttcgtgatatctggacgcgataaatcgatttcttccagcggtattaacttcgttttatatctaattttataataggtatacaacacaatgaatagcggaattgccatgtacgtaatcccaattgcttgccaatcgaaattagcaatggaatgaatatcttgtcccgcaatcacaataatactgagaacaaaggcaaagagtggtccaaatgggaaccattttgcacgatatctaagttctgacacgtcatgtccttgtttaataaaagcccgacggaaccgccaatgagcaatcgcaataccgacccaagccacaaagccagtcagtccactggcagcaactaaccatatataaattttaggtcccataatactggaaataaaggttagcaatcctacgatagttgtaccaagtaaggccaggtatgggattcctcgcttcgaagttttaccaaaaattttggcagcaaatccttgtttcgaaagcgaatataacatcctagtcgaggcatacattcccgaattagctgaggatagtactgaggtcaaaataaccgcattcattaccccagctgctcctgctagtccggcccgacggaacacaagggtaaatggactaatggaaacatcacgggctgatgatcctaataaattagggcttgtataagggatgatacaagcaattacaaaaattgctaagatgtaaaatagtaaaattcgccaaaatacttggctaatggccttcggaacactagtttcaggtgtttcagattcgccagctgtaattccaatcaattctgtaccttgaaacgagaaaccagccacaacgaaaacactaagaatagcagggatcccacccacaaatggggctttatgatacacaaagttttctaaatatgtggctttacctcccataattccgacaatggttaaaactcctacgaccaaaaatataataaccgtgactaacttaattaaagcaatccaatattcagtctcaccaaaagctttaaccgtcaaagcatttaccaagaaaactagcactagtgccaacaggctccagatccaccccggagcgtgcggaaaccagaatttcataatcaaggcaatggtactaatatcaactgcaaccgtaatagcccagttaaaccagtaattccatcccattgcaaagccaaaggctggatcaacgtatttagttgcgtacgttgaaaacgaacccgaaaccggcatataagtcgccatttctcctaaactagtcatgaggaaatagaccatgacccccatcccaacgtaagctaataatgcaccaccgggacctgcagtagagattgccgatccactggctacgaataatcctgtaccaatacttccacccagtgaaatcattgaaatatgtcgcgtctttaaggcacgcttaacctgactaccaccttgttctgccataagaaaacctcctataaaataaaagaggcgctgttgattttcaaaaaacaaaataaaaagcctttttgtgagcattcctacgcacaaaaagactgtttaaaatcattagtcaaatcgtagatagcgctccgcaattttcattgcgacagtctctggcttattcaaccagagcccaaatcgtacatgaataagcatgtagtcatttcggcctcttttcctttcaattcgggtcattgatgcttagtcatctagccggatctactaataattgaggcaacctcttctttcgatgtgattcaaattataacaaatctgttcaattattcaagtaattttacatttaattcgtagcgatactctttttgtgaggattgatcataaccagagattcccgtggtaatcttttctaaacgcttaaaaccattgcgctttagtacttgctgagaggcatagttgtcaatacaaacattagcaaaaactttaaaatctcgtttatttcgatttttcaagtttttaattgcaaaatgtactgcttttgacataataccttggttccaatactcttcacccaataagtatcctatttcatatatatcttctgcagctggctgaaaaataaaaattccgcccacaacttggtctgcttcgttgacgattgctaaaaagccttgacgtccaaccatccctttaaacgccatccattgttcaaacgcgtttgtcagaatcttcatccccgctgatttagcaatctttcgattattagctaacgcctgataattactaaaatcatcttctaaaaaatatcttaatttaaacttcatttcgtagttccttaccttttctttggtgaataacagtaaaaagattaaaatgtaaccaaatatataattctcaaaaaggagtcaacattatggaaattgttaaaactaaacttaatcatactaattctaaatcaaaagccgaattaatttcatatatatcgcccaatttaactgatcaaaaaagtccatctttaatctttgtgcccggtggatcctacacccacatcgatttagctcaagctgaaaaagttgccttacgtctagaatcatttggttatcaagtctctgttctaaggtactccttggttgacgaagtccagccgctttatccagctcccttaattgaattagccgaagcaatgaatattacgcatcaaaacgctgaaaaatggcagattgacgccaatcagattattttaatgggcttctcggttggcggtcatatcgtcagcaattttaataataactggaacgcggactggcttagttcacaaacccatttggcgtcaactacattgcagccttttgcaaccatcttaggttttcctgtaattactcctaacgatggttttcctgacactaaaactttagctaaatggaccactcaacctcaacaattagcagctgatcaaaatgccactaaagacaatgccccaacctttatttgggcaacggccgatgatcagttagttccatcccaaaatgcggttgattacttcttagcccttcaaactctgcaggttccaacagaactgcatctttaccagcatggccctcatggtatggctctagccgatgaaactaccgcctatgataaccatcacgtcgatcatcggattgctacttggttaaccacggcgctagcctggttgcatgaattgaaataagttcgttattaatgtcgatataccaattttttgtgtactatttgttaaactttcttaaacaaagttatagataatccattaatttggtatcatattaatgattgaattttttagtataactcggaggataagttgcatgaattctgaatcacccagatccaattcaagccgattcagcagaaaccggttcaattacacacctgatgacaataataacaatggtgacaacggtcaaaataaacaaaaccagcgccgaaaaccacgaaagaaacgacctcgtagaaaaaaaaccatcattgtcgtttccattattgctgttatattggctatctttggggttaagaaatggtacgatgccaaaaatgctgtagattcgatttttgatagtgctaaaatccagaaatcacgtgatgtttcagctaccttaaagcaaagtaaaccaatttcaattttgcttttaggtactgatactggggccctcgggcgtaattatcgtggccgaacagataccattatcgtggcaaccttgaatcctaaaaagaaaaaaatgactttaactagcatccctcgggatacggttatgtcgattcctggttactcaaattattctccttccaagattaacgctgcttatgatttaggtggagccggtacagcaatcaaagctgtcgaaaaactactaaatattcccattgattattacggcttaattaacatgggtggcttagaaaagattgttgacggggttggtgggatcgatatcactcctaaattaaccttcaaatatggacatgccgacgttactaaaggtaaaaaaattcatctaaatggtaaggcagcactggattattcacggatgcgttataccgatccaaacggtgactatggtcgtcaaactcgtcaacgccaagttttaatggccattttacgtaagagtgattcaattacggctttattaaaccaaaatttcttaaattctcttcaaaaacaaactaaaactgatttaacatttaacgaacttttagcactttcgactaattatcgagttgctacccatcatttaaagtctactcacctccaaggtaatggtactaccatcgatggtggttcttatgaattagtttctaagagcgaacgtcagcgtgttactaatttcatccgtaaagcccttgatttatctgctaaagaaactgggacaactggattaagcagtatctatactggcgaagaagatgataccgatactaccaattcagatactaacagttcagacactactagctcctccactgaagattacggaaccacgagcgcatcttcggtggagacaccggctagtgacacaacaggcggtgcagataacaacggagctacaactgataacactcctacaactccatcacaagctgatccgcaaggaaatgctactggtaactacaactactacggacaataaagctttaattaaagaacaaagggcaatcctgattttaaatcgggattgccctttttataattattccgttaatagcttctctgccaatgcaaaattaccgacattcgctgacccattatttttaacttgaggcatcgtgatatattgatccaaatctggcacagtcacatagccattaagtaatttatcaaattcttttcgcactttctctaagagggttgcattagtaactccaccaccaaacacaatcttgtttggtcgtaatattaatgtactttgtacagctgcttgagcaatataataagctaaaatatcccatgtcttatccgtcaaaggcacatccttaccctttttacctaatcgcgcttcaaaagttggtccagcaaccaatccctctaagcaatcaccatgataaggacaaacacccttaaaatcaagatcttcgggatgacgtttcaaagggacatgtcccatttctgggtggccaatcccaccaatcaaatgtccatcgataaccgcacctgcaccaactcctgttccaatcgtataataaactaatgaattaattttttcgttaaatagcgttgacattgtatactccccataggccgacccattaacgtcggttgtccaagccataggaacattaatttcttttttcatgtaacccaaaaaatcagtatctttccatcccggtttaggagttgtagtaataaatccatacttaggcgacgtttttcgaatttcaatcggaccaaatgaagcaatacttaaagctgctatatcaaattgtttaaaatattttacaacggccgacaatgtcgcttccggggtcgttgttggaatttgaatttgatctttcacctgataatcttcgttcccaactgcgcacacaaacttggttccaccagcttcaatactacctaataacatttactttcactcctataactcaaatttttcaagtcaccatggctaaaatttcgttaacttagatgtctctttctactagtaaatcgctctataaaatgaaagtcaagcaacttttgtattcgctttcaaaaagaaataaaaaaaatgccaaaattaatttgggcattttttaatcctactctttttcagtattattagcacttttacttttgctacgttgtttgtgttccttcaaagtaattataattttacgttgcaatcgatcgataaattctgccattaaaaaaccgattccaattgaccctgcaatttctcctacttctaacataaaatgcgttgccatatcactgttagaaagcgcaaagtttcgaatcatctggtatgcttgtcctcctggaacgagcggtacaattccaggaatattaaaaataatcatcggaagtttcattcgcctagcagcgtataagcttaataaagcaatgacagtggtcgctgttaaagcacttaacgctaagcctaagcgcacttggagcatcgcccagtaaatcgtccatgacacgccaccaatggcacctgcagcaattaaagcccgtttaggtatattaataataattccaaagccgatggtggcaatgccggccataaaaaattctagtagtaattgcatctcttactcctttgtttacaaaaaacgaaatacgaaggcaatcccaaaaccaattgcacatgctgataataaagcttcaattccacgagccggaccactaaccaagtgaccatttaaaatatcgcgaacagcattagttagtggcacccccggtactaacggcatcactgatccaataataatatcatcgatagaatgtccccaaccccaacgcactgcgaatacagctataattccgattataattgatgcaaaaaattcgctaatatatttaatatttaaaatccgatttacaaaataaaatagcgtgtagcctaacgccccagtcaaagtagtaattcctaaatcaaccatatttccagaaaaggctgtcattaaaggtccactaactagggctgctccaatcacttggagccaaaatgggaaggatggcgtcgcctcatccaaagtatttagtttttcgtaaaactcttctaacgtaatatctttggccgcatagcgtcttgaaaaagtattaaccgcagaaactttctctaggtcaatcgctcgccgattaatcccttccacctgagagtccattgaatttggaattgaaacaataattccagtaatcgtcccgaaaatttttaaattattaacacctgaattcatcgcaattcttttcattgtatcttctgctcgtgacatctcagagccattttcaatcataattcgacctgcaagtaagcaagtattaataacgatttggttagtttcaatcatccttcaaggcctcctcttcaattaattcattatacctaattaattaatagtatttaactaaatctttatattttgcataaaaaaagagtaggttgccgaagctccctactctcataactattttaatttaaattagtttttgtttacgttaactgcttgtggtccacggtcgctttcttcaacgtcgaaagaaactgcttggccttcttcaagagtcttgaatccgtcaccttggatagctgagaagtgaacgaatacgtcactaccatcttcgcgagtaataaaaccaaaacctttatcagcgttaaaccatttaactgtaccttgttccattatgaacatcctcctgtaaacctaatctatatagtaatagacggcattgtttaatttgtagcttgagccggtagtaatggggatagttcaaaatgaaacgatctgaccaaaagcacctaaccaaaagcacaagctcattatagcatgctcaaaaaaaaaaagataccttctttaatattttgttttaggtcgctaaaacattgatagattaataattaaaaggtttttcttccaaaaaacaaattattttttagaaaccgctttaccaaaaaagtcgttttggaccggttcaatcaggaaataatcaaaaaaaagaacctaaaagattaggcccttaagtaaaatattttaatgttgtcgttgatgtcgtccccctgaaggagcaacaaagctggcaatccaatcatatagcatctggtaaagccataaagcaacccatagccacactatgcctaaagctaccgccgtaaccgtatcagtaaggtaatgagcccccatataaattcgtgaccacattactaagacttgccatagaatcaatcctcgaaaagcccaacgccgcttactatcagactgaattggacggacaaaataaaggtaaataaaagctaacactaaaaatgcttcaaaggtgtgcccactaggcatactaaaacctgtttctggaataatttgatcaatagttgggcgcggacgcttaaccaattcttttagaataaacgctactacagcgccaccaaacattgtacaaatgacccagatagcatctactcgttgctgttctttaaaccacaaatatactgcaataatgattgcataaattaaaccaagcttggtatctgcaatcatcgtaattaagcgcatgattggttcaagaaaagaaaaagccgttccttgaacgatactactaaataactggtcaaaaaattgcataaatgtgttttgtagcttaacacctagtgcaagtaaaacaacaacgactgcggatacaatcacataccctctgggtatattatcagtatcttttaacattcctaaatccccctaaattcactgttaccattcttttttaaactcatttacgaagcttttcatatactccgtccgttctaccgcaattttttgtgctaaaggtgtgttcatgtcatctttaagcttaaaaagtttttcgtaaaaatgattgattaccgttttattgtcacgatattcatcatgcgtcattttttcacgaggttggatttcgggatcatataaaatatgtccatgtgcacccccgtaataaaatgtacgggcaatgccaattgctccgatggcatccaaacgatccgcatcttggacaatctgtccctccaaggataatttatatttctgtcctaaattatcagaaaatgacatatgcgtgataatatcgaaaatatgagcaatatcaaaatcgctaactccaaggcttcttagaaaccgagctacttcatttttagcaacggcctgattctcaactaatttttcatcaatcacgtcatgcaaataccctgcagcgaaaactacaaactgatttacattttcagtgcgatcatcaattaagcgtttagccatcttaaccactcgttgaatatgagcataatcatgcccggttaagtcatcttgaagcttctctttaacaaaactatcgattttttctaactgtgcggtgttgtcttcactcatgcttgttttttctccacgtattctacaatctctaactttctaacaaccgttaccttcacctgaccaggataagtaacatcctcttcaatttgattctttacgttagtagctaaactatgaatcgtcttatcatctgtctctttaggttgaacaattactcgaagctcacgaccagcttggatagcataactttccttgacttctggatgtttgttagcaatctcttctaagctcttaattctttggatatagtcagccactgattcacttctagcaccttgacgagctccagaaatggcatccgctgcctcaaccaaattagcaattacatatcgagcttcaacatccccatggtgagaagcaatagtattcactatcactggactctctcgatattgggtggtcaattccacacccaattccacatgagtcgcttcaatatcgcgatcaatagatttaccgatatcatgtagtaaacctgcacgtcgtgctaaagtagcgtcttcacctaactcaacagcaaaaatacctgctagcttagcagtttcaatagaatgttctaaaatattttgtccataactcgtccggtaatgcattcgaccaataaatttgattaaatccggcgcaacatattttaatttcaattctcgaaccgcgtcttcaccatactggcgaatacgttggtcaattactttattagccttattaaccaaccgttcgattgtatctggaacaactcgtttctcagttttaatcatttccatggtttccatggccactgctcgacgaactgggtcataaccgttaagaatgacctctttttcttggtcgtcaatcacaatatctacaccagttaatgcttcaattgctcgtacattctgtcctgaatttccaatcagtttaccaagatattcagcattttctgcaataaaactgcggtgattttcggcttgacctcttggaacatcactatgttccatggctaaagctatcaaatcctcagcttcacgctcgcaggagctttctaattcggtttgagcgttattaacaaactcatctttagaacgaattgcatcttgtttagtttctttcaaaaccaactttgaagctgcttgctcttccaaatcagcaacttcctgaagtttattccatcgatcagtaattagttgtttagcttcgcctaaagttgtccgtacgttgtcacgttcttgtaatagactttgtctttttttagctaatgcatctgctcgattagttaacacaatctttttttggttcaataagttcattctttgttcaatccacgcctctttacgttgattatcatgtagatcatctgcgagttcttggtcaatggtctcttgatattgttgagtttcttgaacactatttttttcatattcagccacttcggctttagttttttgccgttcatgttcaataattttttctgccgctttgcgggcttgcgctaatgtttcactatgctttttggctcgcaatccataccctactccaatggaagccaatagcaaaacgacgatcaaaatcgttgccatcgcgtcgcccctttctttttagtcgaagttaattatatcataaaaatatattcaaaaagttggtacaaaaaaagagcttcttagaagaaacttacgttaattcgctccccatagtccactctttttaaatgtaaaattttattgttccaccatgcgccacataccttcgccagctttttccatatcattaacaaaactcaataccattttggcacgatcgggatcttgttcgaataatttgtttaagccttcacccgttgtcattggagttcctagattaaactgcccttcacctaaatctgcttcggaaaaggctaggacccaatcgccggtatcaatttctgtatatagaaagaatagcgcatattcgtcacttagataagccggaactgcccatacattttccccaacttcttgggttgtattacccataaagttatattctgacgcattgctagcgtttacctcatgcgtcatttgcatcaacatcgcattaaattctggttcgcctaacgtcatttctacgtcttcaaattcatttttttgtgtcattttgttctcctatctgaaactgcaattatgctactcttccatcccgatttgctttaaatcatctggtaattctgctgtaaaactaaccttttcatcaataaatggatcaaaaaatcggatcgatgaagcgtgcaaagcttgccgtttaattcctctatccattggtccatcgtataactgatcaccaactagagggtgacctgcattcgcaaaatgaactcggatttgatgggttcttcctgtttttaagtgaacttgaaccagcgtttgattttcaaaacgtttgagcactttaaaactagtagtggcttgctgtccatcgtcccgtacttctcgatgaattccatcggctgctaaccctaacggttgattaaatgttcctttttcagcttgaactactccatcaaccatcgctaaataaatctttttaattttatgatgcgcaacttgttcacttaataaactgttagaaacttggtgacgggcgactaaagttattccactcgtaaatcgatctaaacgggtaactaaatgaggcatcatatttttagattcaatggcctgccaatgacctttaatccggttgaccaatgtatcttctcgatcacttggaccagggaccgcggttagtccagcaggcttattaactaataaccaatttttatcttcaaaaataatgtctaatggaccatcactaattgcaacattttgatcttgttcttcatcaggcaattcaatccaaattggttcaaaaggcattaatttatcactaaattctacatcgttttcgttttcatcaatcaggcgaccctcattttggattctttgcaataatctctggctcatccctgatctttgtaatacttttttggcactaataatttcttctaagttatttttaaattggtatcgcatacgtactcccattcatctggcataattattacatcattaaagccattatatacgatttttcatattaattaacgaattcattctctttatttttattttaagttggttataatgaacttagctctatcaatggagtaggaatcgatgcgttaagtgccaacaagacggagagttgcttgttggacgaatgcttgtcagcgatatcgattccgcatctcgccgttgaattgggaagtttttcatgctatttccttttcgttaaaacggccaactaaagactggagggatttgcatgaagaatttttttagtatcaaaaatgttttttctgtgcgaaacctaaccattatggctttgttggcagcattggatgttgtgttagcgcgttataccaccatccatttgacgcctcaattcactttggttagtttcgaatatataccagcagccgttgtgtctgcgctatttggaccttgggcaggaattgtctttggattagttagtgataccgtggggtatttttctaatccggtgggaccttacttacccatttgggccatcagtgctatggttgctaatttaatccaatcgatattcctatacccaggtaaattcgactggtggcggattatcgtggcacgcctcttagtgatgctaattgtcacgatgggcttaaatttcatttggcaatccatttactttggtgcagcagcggccgtttattacaactcagctcgcatcattagtaatattattcaattgccaatccaagtaattttaattcgtatttttggtaaaattgcaatgcgaacggtccagcgactcaatgcgaaccgccaatccatttaataaatttatttgcttttatctaccattcatcatagaatagtaattgattatttttttctgaggaggatcaccatgaagtcaccatacaattcatttgcacgtgcacgtaaagtttctggtaagcgcgaacgtcgtcgccgtcaagaacgcgttgttgctatccaacaatttgctaaaggcaagactgaaacaatcgctgaaacaccaaaagttaaataataaactataaaaagagctgcaaacgaatacttcgtttacagctcttttttagttcacccgtgtccatgcgtcaatcgtttgccctttagcatctttcaggactaaccagctattagttcccgcaaaatacagaaacaaccccacttcgttgacactttttaatattatatcttctgtggttttaaaatccttaaaagattgttgatgatcttctcggattttctgccccattttagcagcaaatctaattgaaccatttttattcaacggcacctcgcgtttcattaccgctccggccctaattaccatttcatttcgctttacccactgaatttctgcccgacattctttggtatccacataaaatggaacctgactaaccattttattccaacggtggctaggcttccttcctagttttgacttttctggaattaaaacatgacccgagccaaatcgattaatgataaaaagctgttgttgaacaaaccgatctactagctcttgaactgctgggggaagtttttctttctttaaatgctttggcaaagtcactttattttttattgcctcatgaatgaacccttgtaacacatgatggagtttcaagttagcaggaatagaaattaaaattaatcggtcccaacgattccccttcacttctaactctttttctacttgaaaaatatttttaacttttcccttaaatagtaaaattccaataccagaatggttaacaactggagatttagttccatcgtaaatcttaatttcgattgcatcttcttttgaaataatgttagtccaatgttccttcaactcgacatttaacttcatgagacccgctccatcgtttttcttccattatactcagaaaataaaacaagagaccataccaaatagtatcatctcttgtttttaattatatattttaaattaaactattctctatcaacggcttggttaccgttcaatagaatattcataataattgctgtgatacagcctactaccatcccattatctaaaattgtttgaactgaggttggtaaaatgtggaagagcgttggttgaatagttacacctaaaccaattccaatcgatacagcaattaccaataaattattaacggtcattttaacgttagctagcattttaattccttgggcacccaccatcccaaacattactaacattgctccacctaatacagatgtcgggattaatgtagcaatcgcgctaaacttaggaatcaatcctaaaatcaaaagcattccagcagagaaataaattggttttaatttcttaattccagataattgcacaattcccacattctgtgaaaaagttgaatatgggaaggtattgaatatcccgcctaaaatggctgcaattccttctgaacgatatcctcgttttaaatcatcggctgtcagattccgtttggtaatatctgctaaagcaaagtaaactcccgttgattcaatcatacaagttgctgctgccaagagcatggttaaaattgaggaccattcaaatttgggagttgcaaaataaaaaggcattggaatttgaatccagtgagcttggctgattggtgtaggatcgattagtcccattaccactgctatcactgagccaacgataattccgatcaaaactgaaatgcgtttgatgaatccgtgcgcaaaaacttgaattaaaataataactaaagctgttaaaaatcctaaaattaagttagaagaacttccaaagtttttatcagcaacgtttccaccaccaatgttctggaaagcaacggggattaaggtaaacccaattaaagtaatcaaagagcccgtcacaacgattggaaaaaattttcttaaactagcaaataatccgctaattaaaaacacaaaaattccggctgcaattactccaccatacatatacccccagcccattgtattaccaatgtgctccatcggtgccaagtattcaactgctgatcctaaaacaactggtaaagcaatcccagttagtggagtgcgtttaacctgtaaaaaagtggcaactccacacatgaaaatatctactgagattaaataggtcatctgttgcgcattaaacttaagcgccgccccaattaataatggaaccaatatatctccggcatacattgccagtaaatgctgaaaagctaataaaatcgtctttggtgttgatagttcaacatttttggcaccttgtttttgtatatcttccatatttcctccaactccacgtaattattaagatagctacaacgaacattttagcacattaaccttttcattaaaacaaaaatacgaacgttattatttttaaaacgttttatagttcgttaccaaaaacaatttaaaagcgctataatagaaaataacaaatttttaggaggtttttaatctatgaataagaaaattaaaggttcttgcacgaccattttggtcggtaaagatgcttctattgatggttcaacgattatttcccgtaatgatgatggtcatgaagctcttgatcctcaacgtttcgtggtcgttaaccccgaggaacaaccacgtgattaccaagccgttatcagtggtgttaaaatcaagcttcctgatcagcctttgagttacacatcaatgccaaattccattttaactaacggaatctggcctgcagcggggattaatagtgaaaatattgccatgtctgcaaccgagacaatcactactaattcacgtgtcttaggtatggaccccttcgtagagaatggaattggtgaagaagacattgttacgctcgtccttccatatattcacagcgcacgtgaaggtgttaaacgcttaggcgctcttttagaaaagtttggaacatatgaacctaatggtatcgctttttctgataacgaagaagtttggtggttggagacgattggtggccatcattgggctgccgttcgtataccagatgacgcctacgttgtggcacctaaccgtatgaatattgatcaatttgattttgaatctgatgacacgctatgctcagctgatttaaaagatttaattgatgaatatcacttaaatcctgattttgacggttataatttccgtcatatctttggtagtgcttctattaaagatactgtttacaataatccccgtacttggtatggccagaaatacttcaaccctgagattgaaaatgatcccatggagcaagatttaccttttatctgtcatgctaacaaaaagatctctattgaagacgttaagtttgttttgagctcccactttgaaaatacggaatttgatccatatggtaacggtactgaagaccaaaagaccctctttcgtccaatcggtatcaatcggaatcataatgtccacatccttcaaatccgaaaccatgttccagcagaaattgccggcattcactggcttgcatacggagccaatacgttcaacacggtagttcctttttacgctcatgtcaccgacacaccagctgtctataagaatgcaactggtacatttgatatgaacaacatgtattggctgagctgtactaccgctcttttaggtgatacagattacgacttatacgttgatcttcggaacaccttcgaacttgaaaccactggtatttatcgtcgaattcaaaatgaaactgatcgagcaatcaagcaccaaactaacccaactcaatttcttgaacaagctaatgaacaactagctacagaatcctttacccgtcaaactaaattacttggtgacatggtaacattaggatcagctcacatgaaattacgctataacttaaatgattaaaataaaaaaacgattttaagtaactatgatatcttccgaattgagacaaaaattctaagataacagttaatgtcctcatcgacacttaaaatcgttttttttattttttatatttttcaataatttttaaaaagtcttcatgatgatgtttatttcccagatggcgagtagctacttttagaacatgttttttatttttagtatccacaattatgagcttattcgatagaatgctcttttttaaggcaatacttttaattttttgattatcgaaggggataatttccccggttagatttccttgctgagcaacaggcaacagggtaaccccccgatcactcaacgcaatccaatatcccctttcacctttggtaccatagacaatccattcgttagtgctatctaagttattaccctttaataattttttgatttcatcatgttgaacaaccatttttataacttctcccaaaacattaaatttatttcttctttttttaaaagctgaatattactgggtactctaagttcatacattattttggatatcttacattaaaaatatttagataacatactactcacaaaacggacaagttaattaactcatccgtcgtaatttcactatcaaaatttccattaaaccaataaatgatgtatcgattaaatttcataaaagaagtatacaaaccacatttcttaagttagtgctcattaaaatcatgactaaaccgattacttaaaatgttcatcaaataatcttgctttactctgtcatcgtcctaatcttccaaaccatctgaatccaatcttctgatataccgatcgttcttaatttatcaagtacaactagcataatatccatatttacgacttcaaaccctgttcagtttgtttgggaaatcactcaatgacaagtaaaaattatctcgttacttctttactatatctataccacacttacgattaattatagcacttacttaaaacgttttacactttatatagtattaaatgttactaattttttagttaaaaaaaccatggaatcgaattattttaagtcgccgtcatcgttcttccatggttattttttattttgctttatctccaatatcacttcgataacgtaagcccagaattggatgctgatttaaccatccgtacaatattgcttgagctttcgtaatattgctcgctccagtggtcaaacataggattcgtcccccattactaattaattgaccgtctcgattgcaactaacgcccgcataattaactgtaatattggatggaaggtaattaaaatctgctagttcaactccccttgccgaagcttgcggataagtttgcgaactaattactactcctaagtaaacctggtctttttgccatttaaccactggcacttggtggtggagcaatccctgcaacatttcgtataaatcactttgtagctgcggtaatactaccaccgtttcaggatcacccaaccgtacattaaattcaatcactttaggaccggagtctgtcattattagaccagcgtatagaatcccacaaaaagcaatattcttctttttaagtgttcgaataataggacgaataattttttccacaccttcattaaccaaatcacttggaaaatgctgcaagggactatacgctcccatcccccctgtattgggaccttcgtcaccatcataagctgccttgtggtcttgcgatagaggcatgggaataatttgctcatcttgaataaaagccatcaaggaaaattcctgtcccgttaaaaattcttcgataataatggacttactatcaaattgatgttcacccaacattttatgaatcgttgtcgtagcttcttcctgatttttagcaataacgaccccttttccagccgctaagccatccgatttaattaccagtggataactatttttcgctagccctttgattgcggcaacttcattttgataactaacataactagccgtggggacccccgcttcttgcataatctttttagcaaattctttggaactttctagtttagcggctgcttgagtcggtccaaaaatcgttaaccccgcagtactaaaataatctacaattccttgctgtaaaggttgttctggtccgacaaccgtcaaatcaataccctgtttctggacgaactcaactaatttcccaaaatctgtgacgccaataggaataatttcaatgccactttccaacatccctggatttccgggtgcacagtaaactttttctacttgattacttttcaatagctgacgtccaagaacgtgctcccttgcaccatttccaaccacaagtacttttgccatctggtacctccgcttaatgtctaaagtgacgacgtccactaaatattaatgaaattcctaactcatccgccttatcaattgaagcttgatctttgatacttccaccaggttcaacgatagctttaattccatgtttagcagcatattcaacacaatcttccatagggaaaaatgcatccgaagccatcaccgcatttttaaaattggctgaaccttcagcctgtttaaccgcaatttcaaccgaaccaattcgattcatttggcctgcaccaatccctaaggtttgttgatcagttgtaatcacaattgcattacttttaacgtgtttaacaacggtttgaccaaataccattgccttaagttcactttccgttggctgacgtttagaaaccactttgaagtcagtcgccgtttcaactaccgcatcctgttcttgaaccaagagcccgcccattactgaaactgtttcaagttctttagcatcctgatgttgattaaaatcgaccgtcataatccgtaaattctttttttgagctaaaactgtaaaagcttctttttcaaaactaggtgcaataataatttcaagaaaaagtttatgcattttttctgctgtcgctaaatctactggtcgatttaagacgataatcccaccaaaaattgacatcgagtctgcttcataagcgcggtcccaagcttcttcaatattttgacctaatccaattccacatggattcatatgcttaaccgcaaccacggctggttgattaaattcggcgctcatttttaaagcggcatcagcatccttgatgttattgtatgataatgctttgccgtgcaattgttgagcttgagcaatcgaaaatggtacaggtagcgcatcttcataaaaggctgctttttgatgactattttcgccataacgcattacttgttttttagtataagtcttggtaagttcatctgggaaaatttcaccgttttgtccaagatattgagcaatcaaagtgtcataagcagcagtatgctgaaagaccttcaaagctaacactcgccgaaatttaacatcgtccgtctgatgggctagtgcagctaaaactggttgataatctttaggatcaactacgggtaaaactgatgcaaaatttttagccgctgagcgtaacatactaggaccgccaatatcaatttgttcaattgcttctgcttccgtcactccattttgcataatagtcgatttaaacggataaagattaacacaaactagatcaatcaaatcaatattatgttctttgagggctgccaaatgttccggtaagtcacggcgcgctaacaatcctccgtgaatggcaggatgtagcgtcttaactcgtccgtccaacatttctggaaagttagtaatagcttcaacactaacaatagataatccagcctcttccaaaacttttttagttccacccgttgatacgattctaaaatctgccttaactaaacctctagcaaattcaacgattccagttttatctgacacacttagtaatgcagttttcatgggttaatctctccttagttaatcaactttctctgttttaatacttggcagatgcttttaaaatataaatcatgttcaacttgatgaatacgttgagctaaatgctccgcatcatccccttgtaaaatcggtacaggttgctgagcaataatcgggccagtatcaatccctccgtcaatccagtgaatcgttactcccgtaatttttactccatattcaaacgcatcctcaattccatggcgccctggaaacgatggtaacagcgctggatggatattaagaatggcatgtggataagcctctaacaaaactttggtaacaatcttcatgtacccagctaaaatgattaatgctaaattatatttttttagctcacgtaaaatcgccttttcatagctcactttatcttcaaattctctcaaatgatgggtccagactggaattcctaactcatcagctttagtaacaaccggcgcattgggttggtcacaaattaagcatgcaattttaatgggaacttttgtttctcgaatatgttggtgtaatgccataaaattagtccctgttcctgatgcaaaaaccgcaatattaatcatctgctccctcccgaaagataaaccactggtgcatctttctcccgttttttcactttaccaatcttaaaatatgtttctttctgttgttcaagttctgctaccactctggcataattgttgggactaacagctagtaccattccaatccccatgttaaaagtttcataacaatctgtctgggatagctttccaagttccgctaggattttaaaaattgccggcttttcccaactatccaacttaaattcagcctgttgctgatcttgtaacattcgcggaacgttatctaataatcctccaccggtaatatgggcgattccgctgaccaatttttgttttaaaagtggccgaatcacgttgacgtaaagacgggtgggttgcatcaattcttcaatcaaactatcatttaatcctgccaactgatcatcgaactggaaatcatgatcttcaaataaaattttacgaactaacgaataaccattactatgtaatccactggagggaagaccaattaaataatctccattgtggacattttttgcttggagtaaatcacgtttagcagttagtcccacagcaaaaccggctaaatcaaaatggtgtttctgataaattccaggcatttcagccgtctctccacctaacagggtgattgactgagcctggcaggcttttaaaattccgtttaaaatcttttgaacctgatttttctctaaatgtgatagtgctaaataatctaaaaagaataatggcaacgccccttgcgccaataagtcatttacacacatggcaaccaaatcttgcccaatcgtttcaacttgacctgactgggccgctaaaagcactttggttcccactccatcacttcccgctactaaaaccggctgatccaattgatcttttgataactggtaacatccagcaaaactgccaagtccgcctagaacatgagggtctggagcacctaatttttgctttagatcagctacaagttcttcaccagctgtaatattcacacctgctttttcataagcactttctaccattatttttcctccacttgggccattgctgataatgtaaagtcgttagctgttttagggatctcaaaatctttttcataatcataaaggggggtgggatatttaccatcaaaatacgctacacataagccatcattaggggcatcttgatgtaaaccaatcgcctcaattaaacctggcaggctcaaaaaatgcagtgaatctgctccaattttctgacacatctcacttaccgtataattagcagccatcaattcacgtgtatgttcaatatcaattccataaaaacatggatatttaagtggtggagaacttatcatcaaatgcaccgacttagctcctgctttttttaacattttcacaatatactgactggtggtaccccgcacgattgaatcgtcaactaatgccacatctttccccgcaattactgcttttaatgcagataatttcatcttcactccctgttcacgtagtgcttgggtcggttgaataaaagtcctactactatattgatttttaattaatcccatttcattgggaacgcctagttgttcggccactccagatgctgctgataacgaagagttcggcacccccaccaccatatcgaccttaatggggttttcttttgccaatcgttgacccatccgttgacgagcgagatgaacattaacgccataaagatttgaatcgggtcgcgcaaaataaatgtattccatcgaacaaattgataactgggttttagtagtaaaattactaatctgaagcccatggtgatcaatttgaactaactgtcctggttcaacatttcgaaccaaggttgctccgaccgcatctaaagcacaggtttcactagcaacaacatacgaaccgttagctaattttccaattactaagggccgaaaaccattcggatcaagggccgcgtacagtgcatctttggtaaggattaagtaagcaaatccaccttgaatttgttttaaactcgcttttaatttttcaataaaagttggacctttttgatgctgaattaaatgcattagtacttccgtatcagaattagattgaaaagtagcaccacttttttctaattcgcgtcgtaaactaactgcattggttaaattaccattatgggccatcgccacatctccctgtaagtagtggaaaagtaacggttggatattttcaattcctcggtttccagctgttccatagcgcacatgaccaatcgcactcggcccaattagctgtgccaaatcatcgggacatctaaatacatctgccaaaagcccctttcctttatgaattttcaactgtccttcttgattacgaacgacaataccagcaccttcttggcctcgatgttgtaagctgtgaagtccgaagtaggtccgttgggcagcttctgaatcattccaaataccaaaaacaccgcattcttcgtttagaccctttaattcagctgccatgctagggctcccttccaactctccttagtatttttcaaatcaacatcaattacatcatccatcgttgcaattttgatccgcttaccgccaacttggccgattaaagttgctctgtttgccacttgtgcttcaaaaatcttttgtttatctggagcaatcgtcacaataaagcgggcctgattttcggcaaatagttctgtagctgttaaattagtcttgacgtcacatcctaactcactagcgaacgcgcattcagctaaaccaacggctaagccaccttcggctaagtcatgcgcactattcaaaagttccgcgtgaattaactgagtcaacaattcttgttgctcctgttcatagcgtaaatcgaaattaaataatggaccttcaacatgtccgagttgcattttttgtaattcactaccattaagttctgctgttgtttctcccaaaatataaattaaatcaccagattttttaaaatctatggttgttatccaagctggattttcaattaaaccaaccattccaaccattggtgttggataaatgggttgttggttggattcattataaagtgagacattacctgaaatgacgggtgtatcaaataatttacaagcctccgtcatccctttagtagcctgttctaattcatagaaactttctgggtcttcggggctaccaaagttcaaacagtcggtaattgccaatggtattccacctgtagcaactatgtttcgagcggcctcactgaccgcgatttgtccaccataatagggatctaaatacaaataacgcggattagcatcggtcgtcatcgccaaagttttctgagttcctcgaatacgaaccactgccgcatcactttgtgtcgttgaaattgtattagtttgaacttgagagtcataccgttcaaaaatagcacctttatgcgcaattgtgggttgttgcaacatcgcttggaaggtcttagttaaattttcaattttaggttgatactgttgctttttagtttcactgatatgctgaggtttctgacttggttgatggtaaactggggcttcatccaccaaagcatgcactggtacatcagcaacttgaacgcccttaaaggttaattgatagcggtcacctgcagtaacttcaccaatttttactgcttcgctctcgtatttagcaaatagtgcttcaactgcgggttcaaatccttgtttgacacagagcagcatccgttcctgagattcagatagcattaattcataagggatcatttcttcttcacgttgtggaactaaatccaaattcaaatgcattccatatccagctttagcagccatttctgcagatgatgaaatcaaccccgctgctcccatatcttgaattcccactagatattcggaatggttatgaatcagttctagacacgcttccattagttgtttttcagcaaaaggatctccaacctggacggctgaacgttgcgtttcttgttcgtcactaaattcggttgaagcaaaaatggctccttgaattccatcacgtcccgttttagcccccacgtagtaaatggcattacctacaccagcagccgctcctttttgttggtcgttgatatccaataaccccacacacattgcgttcatgactggattgttttgataaattgtatcgaaggtcgtttcccctcctactgtaggtattcccatacaattaccgtaatcgccgattccagctattgtctggtcaacaagatacttagtatgggcatcattcaattcaccgaaatgtaaactgtccattaatgcaatcggacgcgctcccatggaaaaaatatcacgaataattcctccaactccagtagccgctccttgataaggctccactgccgtagggtgattatgactttctgctttaaagaccaccgcttgattgttaccaatatcaacaattccagctccttccccgggcccttgtaaaatctgtgaacccgttgttggaaattgttttaagaggggtttagaatttttatatgcacaatgctcactccacatcgcagcgaacaaacccgtttctgtaaaattaggtaggcgccctaaagcatcattgattttctgatattcgtcttcgcttatcccccattgcaaatacaatttttgatctcgaatttcggtaggtgttaatttcttcatcattgcgaaaactcctttaattaaacattttgcgtcatgctttcaattaaactttggaacagcattttgccatcttcgccacctaggacggcttcactagcgcgttcaggatggggcatcatccctagcacattgcctttctgattgataattcccgcaatatcgtctgtacttccgttgggattattttgataacgtaaaacaatttgatgatgatcctttaagtcttgtaaagtagccgaatcacaataatagttaccctcaccatgggcaatgggaaacattacggtctgttttaaatcaaaacgtttggtaaagatagtctgattattttcaaccactaatttttgtggtttacaaataaaattcaaactatcattcgatcgcaaggcccccggaagcagcccggcttcggttaaaatttgaaatccgttacaaattccaattactgggtttcccgcataggcaaatttttttacagcatccatgatgggagaaaaacgtgcgattgcgccgcttcgtaagtagtcaccatatgaaaaaccgcctggaattaagactgcaactgtatcttgcggtaaggatttttcgcgatagtccacaaattgaggcacaacgttcataacgtcgcgcaaaacatagtacatatcccaatcacaattagaccctggaaaacgaataatgctgtaaatcattgctagtcctcctcaatcctggtaatctcaaatcgataagtttccatgttaatgtttgctagtagctcatcactcatttttctaacttgctcttcaatattttgaccatgatcttcaatttttatttcaaaatattttccgacagttacagctttaacattttcgtagtttaatcgatgtaacgctgttttaattgcttctccttggggatctaagatcgattctttgtaagtaacgtaaattttggcgttatacatgaacttcctcctgtgaattattcaagcgatttaaaacttcctgatagacggtcactaaatctccagtttttttacgaaaaacatctttatcaagtgattctttagttgttaaatcaaccaagcgacatgagtctggtgatatttcatctgctaatacaatttcgtcatctgcggttttaccaaattcaaccttaaaatcaaccagttgcaaatgggctttagcaaagcgttcttttaaaatttgattaatttctaacgccatcttttccaatcgttgactctcttctaagtcaatgattttcaacgcaattgcttgattagtattaataaatgggtcatctaattcatcagatttataaaaaaattccacaacaggctggtcaaatgcttgtagatatgaaacatcaaacttacgttggaaactgcctgatgccgcgttacgcacgactacctctagtggaataatttttactttacgattcaattgttcgttgtttgaaagtttttggacaaagtccgtgtgaatcccttttgcaactaattgctcgaataaaatacaatcgatttggttattcaattcacctttaccagcaatgtgatctttacgttttccatttagggcagttgcttgatccatatattcaacccacaccaaatccttttcatctgtattgtaaagtctttttgctttgccttctttaatcaacgtggtcttcttcattattttatctcccaaatattttctgatttaattgaatctaagcttttttgaatatcacctaatattgtgatgtgtcccatttttcgattcactcgactttcggctttcccatagtcatgaaaatgccaatcgggtctttgaactaacttctgacgagcagcttcaaggtgctgcccgagaagatttaccatcaccgctggtgtagtttgtgtgacttttggtaaagccaatccacaaatgctccgaatgtgagcttcgaactgtgaaatattacatgcttcgatggaataatgtcccgaattatgtggccttggtgccatttcattaaccaataattggccattttctagcataaaaaattcgattcctaaaacgccccttagttctaatttctgagcaattttttgagcaatttttcgagcattgtcttgtacgttttgagaaacccgggctggtacaatgctttgatgtagaatgtggtgctgatgttcattctcggctactggaaaacattggacgattccttcgcggctgcgcgttaccatgacagataattctttagtaaaattttgacgttgttccaatatacatggagcttgggctactaaacgttgtccagcaagtaaatccgcttcggaattaatatcttgttgtccatgtccgtcgtaacctccttcactagttttcaaaatgcttggataacctaatttagcaattgctacttctaaatcagtaggcttttcaacaacttgataggaggtaaccggaattccatgactgctcaaaaaatttttttctcggattcggtctccagtaatagctagtaagttggttccttgcggaatggttaccaattcttgtgctactttcaaactagctaaatcaacattctcaaattcataagttaaaacatcgctccgccccgccatttgcattaaggcgtgatggtcagtatattcggctacaatctgaaaatcacaaacttggctggttgggcaatctcgcgtaggatctagaacccccaccttatatcccatagctttagccgctaacgccatcatttgacctaactgcccaccaccaataatcccaattgttgccggcggtaaaataatccctttttcagaattgcttttcactctcaatagcctcctgagtctgtttttgacggaattcaattaatttttcagcaacttttttatcgattaacgctaaaatttcagctgctaataaagcggcatttttagcacctgcactcccaatagccgtagtcgcaacggggactccactaggcatttggacaattgatagtaatgaatccattccgtgtaatgcatgactttcaataggaaccccaattacaggtgaaattgtgttggctgctaacattcccggtaaatgagctgctccgccagctcctgcaatcagcacggcatatccattttcttgtgcttgttcaccaaacttctgtaatactttcggcatccgatgtgctgaaataatatgacgatcataatcgacttcaaattcatcaagtatgtctgtggccagtttcatggttgaccaatcagaaattgaacccataactactgcgacttttctcatgacaattcccttccatatttaaatgctgtatcaaatttcaagttcagtgtaacaagtaaaattagttttatcaagatattttacgaactttttattttattttttaataaaaagttcgtttttgaaaaataaacagttcgacacgttaattaaaagctcggaaattaataaaaaaagccttaatgcagtatttagctacatcaaagctttttggaaattaatatagttttaaaaaacaaatttatgttttacaacttcagtttcttatgataatatgataatcaaattaaacatcaatgaagacaaaaagagagacgagtagaatttatcattctgtcagtgagttgggataagtgggaacccaatcagaccctgatacttttgaataacactttcttagtttctaactgaaatagcataggctaaagtaggcttagacgtgaccggtacgttaccaatcggaggagtatgtttgtactcttattgaggtggcttattaaatataggcaacttgggtggtaccgcggaaagtctttcgtcccttgtcatggatgaaaggctttttcttttatccttaaaatctaatttattaaaggagaatcaattatggatttaattattcctgcatcatacgatccaaaattatcagtacgtcaaacccaagaggccattcgctacatccgcgaaacttttcaagatgaatttggaaaagaactcaacctctcacgtctctctgcaccaatgttcgttcctagtgccactgggttaaacgataatttaaatggagttgaaaccccagtttccttctctatgcaagatatgcctgaaaccagcatcgaaatcgtccactctctagctaaatggaaaagagttgctttgaaacgctttggtttcgagatgcacagtggactttatactaatatgaatgccattcgtaaagacgaagatcttgataatattcattccatctatgttgatcaatgggactgggaaaaagttatcgatcaaagtgagcgtaatctaactacccttaaagcaacagttcaaacaatttttaaagtaatcaaacacatggagcacgaagtttggtataaatatcctgaagccgtctatcatcttcctgatcaaattcattttgtcactacccaagaattagaggatcgttttccgaaattaactcctaaagaacgcgaggacgccatctgtaaagaactgggttgcgttttcttaatgcaaattggtgggacgctaaaaagtggtgaacgtcatgatggacgcgcaccagattacgatgattggcaattaaacggcgatattttattttggtatgaacctcttcaaaaagcccttgaaatttcaagcatgggaatcagagttagtgaagagtcgatgctaaaacaactaaaaatagctaacgcagaggatcgaatccatcttccttatcatcaactgttgttgaatcatcaactgccctacaccattggcggtggaattggtcaatcacgtctttgcatgttgctgttaggtaaagcccatgttggtgaagttcaagctagtgtctggcctcaatcgatgattgatcaatgtgaagaaaatcaaattcatattttataaactaaaataaaaaagctatgacttaataagcgacttgtccgtcgtttagaaattgagtcatagctttttgtattttttaatcttgatccattgagtaaatcaaggcttgtaattctagagataaatcaacatcatggatagttacattataaggtacatcaataatttcagtggtgaaattcataattcctttgatgcctgcttctacaagtaaatcggtaacccgttgtgcttgtgaattaggcactgttaaaatggctacttcaatcttctcatctctaacacgttgcttgatttcattaatatcatagaccggaacttcgctttgaatcgtacctactacctcaggattaacgtcaaatgccattttaatccgagcattgcccgtcttatgaaacttgaagttaattaacgcatgccccaaattacctacaccaacaatggcaacattagcagctgtatcttgttttaaaacgtcgttaaataattccaataaaatcttcacatcatatccatatccacgtcgccccatttgaccaaaataagaaaaatcacgacgtacggttgcagcgtcgatttttaataaccgttccaaaacggctgaagagactttatcttcgcctttttcatttagttcactcaagcaacggtagtataatggtaaacgacgagttgttgccaatgagattttattatcatccattttttcttccaccttttctactgaattacctttaataatcctgttaacattttggcatgaacttgattattttccacaaagttatgaagaacaaccataccttgttttttcttaacattaaatgcgataaccccagttggactactgccgtaaaatacgtcagcattggcgctaaaacgactccaaccaagtgattgcccatcaatgttgaatttttccatcgtatcaaatagctgtggatcaaggacttcttttccttgataattaccacggtttaacatcatttcaacaaatactgttaaatcattcaaggttgaaaataatccagtgtaaccactttccccattcaacaacaagcccaattgatcttcaacttgtccttggatttgtcctcgcttagcatcttttctagttggtacaaagcgagccttaggacggtttaaattaaaaccagtattagtcattgctagtggatataaaatgcgatcttgaacagcacgatcaatggaaccgtctactgttcgaataataattcctagcaccacaaagttaagtggtgaaacttgcattttttcaccaggtttaaaatctagaccgacagaatatagtgcgttagtaaattcgattcctgtaaaatgtttcgatttattaaccgttactggtaatccactagtatgggttaataaatgtaggattgtaatatctcgatttgaaaaaccaggtaaatatttagtgactggatcttttaagccaatttctcgaattgcaagtaattgaaaaattcgagttgtggttgcaactacctctgtcattgtacttaggtcataaatcatcgaaggatctaataaaacggcagatggtccttctccttggacaccttcataacgattttcaatttcttttggcgtaatcaagctataggaagcaccataaatattatgattctcaatttcctttttaataacttgatgaacttgatgcatttgctcagtcatatttattcacccactctttacttaattgcttctggttcccaatcaaattctaaacttggatcagcatttaacgtcatatcagcaaaaacttggtgtcgcattaacatttcaccagcagcaccaatcattgctccattatcaccacaaagatccaaaggtgccttaacgaaatctaaatgattaaatttttcgccaagttctttatctaaagtatcccgtaaaccacggttagctgcaactcctccagctaaaattaattgttttatttctaactgctcgcaagcccgaaccgttttagccgtgataacatctaccacgctttgttggaagcttgctgctaaatcttttttgctgagttcttcattaatttgatctgcatgatgcactgtattaataaaagcactcttcaaaccactgaaactaaaatcaaaattatcttcgtgttccattgctcgtgggaacttgaagatgtcttcaccttggtgagcaagttcgtcgattgctttacccgctggatacttcaaacccattacgcgccccactttatcataggcttcaccggctgcatcatcacgagtctcaccgataattttaaattcattttcggttggcatatatactagttctgtatgcccccccgaaacaaggagagctaaggctggaaaaacaatgggttttacaaaacgtgcagcgtagatatgtccaatcatgtgattaactgggattaatggtaattcatttgcaaaagcaaaagctttagcagctgaaacgcccactaaaagtgccccaactaatccgggtccatacgtaactgctacagcatcgaggtcctctttacgtacttcagcttgctttaaggcttgttcaatgcagatggtaatttgctcgatatgatggcgactggcaacttccggaaccaccccgccaaagcgctgatggctattaatttgtgttgcaattatgttagataaaataatgtcaccatttttaataactgcaacactagtttcatcacaacttgattcgattgctaaaattaaactagtttgatccacgatatcctcctcgccacttcgacaaatctaatgtcatatcaattgcatcttcatgatcgccgaaataatacctcttcttgattcctgtcttttcaaaaccaatctttaaatataatgcttgagctgtaatattactttttcttacttctaaagtgattgatttgtattcaataaattgagcttttttaatgatcgactcaattagaaatgatccaattccacgattttgatattccggtaagatagctacattagtaatgtgcgccattttactacgatcatcaaaagaagctccgataaagcccaatagttggtcattatgcctaataactaaatataatcggtctaattttcttcgcaattcgttggcaaaggccattcgatcccaaggggtttgtccgtcatacacagcacgttcaaccgttaatatctccggaatatcggtattagtagcctgcgctacaaaatatctttcaccttcgattacaacattgtggtgtttaatttcaaaagcctcctcacgcaaacgtcgtgtccgattaaaaaaagtgtatttagcccaattaattaatttgtctaacatatgattctttgttttcatcgtttggatgcttttccttccaatttctttctgcttctgtcactcgtaaataagctggtacaaaagtataaacattttcaagttctgttttttgtaatcctaagattcctaatgcatgcgcatttggtaaactgtttaattttccagaatgttctgcaacaacaaccaacgtattttctaccattgtttgaaattgttcaaattgagaagatacaaagtaaactggtcgacctaactcattaatcttagccaataatttttcaaaactaatatgttggtctgctagtacgtttacaacttgttctccatttttctcataaattccggcgaatacatttccatttctagcgtcaaagaatgggactactaaaccattttgaggtgcgttaggaaccaacatttctaaactagatactcctactaactcagcatttaacgttaatgctaatgttttggccgtagtaacggcgattcgtaacccagtatatgagcccggtcctttggcaacaacaatccggtcaatttcgtttagtgccatccctgcttctgcaagagtttgcgaaataattggcatcagttgtttactatgatttcttttaatattagtggtttgcatagctagtaattgttctgaatccaaaaccgctacacttaaagtaacgttggacgtatccatagctaaaatcttcattcagttcgctcccttttaattcctctacatattatcctacagaatagtgatgacgacaacaaagaataaattcgtcctttcaaggtcatttctttcaaaattaaagaggttatgacaaatttttatgtcataacctcaattaaaattatttatacgtttattttagcggtcttcataaccattgggatgtttctgagtccaattccacgcagttttaatgatttctttaacgtcatcatattgaggattccattttaagattttgcgtgctttttgacttgcagcaattaatgaatctggatctccaggacgacgagccgcaattttagctggaatggcttcaccagttgcttcacgtgctgcttcaaccatttctttaactgagaaaccagttgatgaacctaagttgaagacgtcgctatcattacctgctttaagataatcgattgctaaaatatgagcatccgcaagatctaaaacgtgcacatagtcacgtacgttcgtaccatctggagtatgatagtcatcaccaaaaatttgtaattggtcacgtttacctaaagccacttgcaagataattggtgttaaatgagtttctggtccatgatcttcgccaattgaaccatctggataggctcctgctacgttaaagtagcggagggctacaaatttgattccataagcttgatccgcccatttaatgattttttccatcattaatttactttcaccgtaaggattgataggggcttgacggtcggtttcttcgatcggagacttttcaggaactccataagtagcagctgtagatgagaaaataatacgttttacatcatgatcccgcatttcttcaagaagagcaaccattcctgccgtattattatcaaaatacttaagcggtttttccatggattcaggaacaattgaaaatgcagcaaaatgcacaactgtgtcaattgcttcttgatcaaagacttcctttaaaaaggcatgatctcggatatcgccctcataaaattttacgcctttatccactgcgccacgatgaccagttgataagttatccacaacgactacatctcgattttgttcgactaatcgcttaaccatatgtgaaccaatatatccggctcctccaactacaagaatactcattcattcatcctccaatgtaaaatttaaactacgcccattgtaaccttaacggtgattccattcaacatttgcttcacaacacaaggtgtcattagcaaaaattttatgatcacttttgagtgtatcatgatccatcgtaaaagtgctatgggcaacctggttaggttggatttccacatgataacgaatgttaatcatcgctggataatagttatttagagtatcttgatcaaccgtattaaaaatccattcaaaatatttagcattattcacatgccgatttggatcaatatcaaaatattctacactgaaatccttagcaactgatgctccttcaatggtttccagtttaggcaaacgaacaatacgtttaacctggtcagcttcatagggttcaataatttcaggtaggagcttgtgcattcttcgcgttgttcgatccatcaatacaaaaattgaagtgttttccacaatcacttcacctttttgatctttaacccaaaaatcccgttggcagaaataatcattgttattaactgctctagttcctactacaatttgttctccaacccgtggtagtcgtttgattttcagcacgtattgcgtaattacccagcctaatccggttttatccacaactgcatttccgacacctagttgctgactttgattatccgaagttaacaacatggcgttaataatcatgggaactttcattgttccggtctggtcaccttcgtaatgcgttactaaatgttgttcttcatgtatctttccagccattattctctcctattgctctaactgatgatagatgtcataaacttcttgtttacttaaacctcgcaatttagcgacctgtttaatcgcaattgttggtttaacttgttcatcatcgataattttttgcacatgttcattaatcgtcatgctttcccactcgttattgatagtaacctgtggatgatcatttccttcgaccatcactacaaattcgcctcgtacttcattttcagcaatccattgctgaacttcttcaatacttccacgaataaactcctcatagcgtttggtaagttcgcgtgccaaaaccattttacgggtcgtaccgaaactactaccaatttgtttgacggtcttagctaaacgatgcggtgcttcgtaaaagataactgtattaggattattttttaaaacttcaagctcttctttttgctctttagttttgcgtgatagaaagccataaaaagtaaagggttggggaactaatcctgaagcaattaatgctgtaattccggcattcgaacctggtaaaggtacaacgttaaggtgttgtgatactgctgcctttactaactcttgaccagggtcactaattgacggcatccccgcatctgatacctgagcaatttgttgaccatcttctaacattttcaaaattgttgggatgcgctgttgagtgttgtgctcatggaagctcatctgtttggtatcaatttcaaagtggttaagtagtttttgagtatttcgtgtatcttcagctaggattaaatcaacatctttcaaaatattaattgctctgaaagtcatatcttctaaatttccaatcggcgttggtaccagatataatcgtccttcattcgattggctgaaacttttttgcgttaacatattagcgatctccatagatgacggttaaacaaaatgcgcactcttcttcatcttgacgatgcttaccgtaaaattcattacaaacgtgatatccgctcgcatataatttttctaagttttgaagtgactttgataaaccatattttgtgttcttggttccttcattttcagcagcggttgcttgctttagacgctctctcaaatgttgattttcaatttgaagttcagcattttcttccatgatttccaccatggcactttgggtttcgtgtagtttatttaacaaatcctcagtatttcgcgtgacttctgttatttgatcaaataaatcttttttatccacactatcgccctctcattttgaatatattacatattttaatcgttgctttttccacaacgctttgaaaatttaaattctgacttaactgatgttttaaaggcagcaatacatctgcaacagccaataattgacggacgttggtctgatcagctaactcttgtaactgacgtcgattagcttcataagtaatcgtttcttgatcaaattttagttctaacaggtccattgcatataacatcatcaagtccaatattttttcttgataaaatcgatccttagccaaagccattactcgagtttgaacatctacaaatgcagttatgtccccagtagtggccgttataaaccacttttctaacgccttatgggcatccaaaatccagttgttatctaccagtgtttgaatttcactcgtatcgttggttaaccgggttaaaattctagcatccgtttcagctatattttgctctgtcaattccttaatcaatcgatctttaggtaacggttttagttcaataatttcggttctcgacacaatagttggtagcatcaaacttctattttcagcaagtaaaaacgccgttacctctcctgaaggctcttcgatgaacttcagcaaactattggctgcactcgttgtcattttattagcttgttcaataataaaaactttccgtgcgccctctaccccgcttttagaaaattcagcttttaaaaaacgaacttgttccaccttgattgattggccatctggtgcaatttctacaacatctggatgttgtcctgatatgattcgagtgcactcttcacattctccacaaggcattgatccctgtaagtcaatacaaaaaagacgcatcgctacccattgagcgacgtctttttttccaatcccacctgctccggttagcaggtaggcatgcgacaaatgctggctatcaatcatttcattaaagcgtttaacaatttcaggttgtttttccacagcctgattagttaaatttttcagatcttccactagaagcgctcgaattgatctaccggaagaacaaggacggttgcaccaccgacttgaaccttaattggataggccgtagtaccctccatattaacgtccatgttaacagatggtgtcataaattcttctctggtatgactagctttcttgatgatttcaaggacttctgggacacgttcttcttcaatcccaatcatgaaagttgtattacctgattgtagaaaaccaccagttgtggataacttagttgctcgaacattttgatcaataaactgatcactcaaatagtttgcatctttatcttgtacaattgtgataactaacttagttgccataataatattcctccgctaatttaaaatttggtctaacacttcaattacatctctttttacatcatcaagttcttgactcgcatcaattacgacaatccgatctggaaatttcttagctaaatctagatatgccgaacggactcgctgatgaaaatctaattgttctaaatctaaccgatcaacatcttccgtccgatgagtcataatgcgctttagtccaagttctgatggtacatccaagtaaattgttttttctggtaatgctccttcagtagcaaagagattcatttgatagacggcatcggtaccaatttttctgcctgctccttgatatgcaattgagctatcaacaaatcggtcacaaaaaaccacatgattttttttcaaagctggtaaaatcgtttccaccaaatgttgtcgtctagcagccgcatagagtaaggcctccgttcgctcatccatctcggtgttgtttttatccaaaataatagttcgaattgcctctgaaatgggatttccgccgggctccctcgttactgttaattggtccttcaaacgctgttggtaatgttcaaccatcgcttgcagaaccgttgtttttccggccccatctggaccttcaaatgatataaaatgcccgttcaccagtattccccgccttacttgttttaaattatttattgtttttattctactttagattttaaggactgtctattaaccttaattaaaatatcaccatattaatttaaaaaaatgagctaacgcgttggtaaaatcgcattaactcatcttttaattattttgctttacatttctgttcggccttcgaccgccttatataaagtcatttgatccgcatattcaatatcacttccgaccgataacccgtgagctaaacgagtaactttaatgccggacggtttaaccaatcttgaaatatacatcgctgtcgcttccccttctggagttgcatttgtagcaataataacttctttaatggcctcgttcttctgtaaacgggtaagtaacgcagcaatattgatgtcttcagggcctttaccatccatgggtgataacacgccatgtaacacgtggtacaaaccatggtattctttcatctgttccattgacattacgtctttagaatcttcgactactaaaaccgctttttgatctcgtgaagggtcctgacaaatatcacatggatcatcttccgtaatatttccacaaatactacagaaacttaggtcccgttgtgctgaaatcagtgccttagcaaattcggttacatcatctttttccatatctaacgtaaaaaatgctagtcgggttgccgttttataaccaatacctggtaatttcatgaaactatcgattaatttcgcaatcggttctggatattgcataacggtctatcacctacgattcttaattacattccagggatgcccttagtgtattttcccattgttttattagtttcgctatccacgcgattcatagcgtcgtttacagcggctacaattaaatcttgtaacatgtctggatcgtcttcatcgattgcttcaggattaatcacgatgtctttcattctatgatcaccggtgaatacaactttgaccatgtcatctggtgccacacccgtaaattcagtttgatttaatttttcttgttcttctgttacctttttttgcatcttttgcatttgacgcatcatgctttgcatgtttcccattccaccacgcatttgtattaccatcctttaatcattttttatatttacattttcagagccaaataattcgaccgcttttttaacagcttgattatcttcatccgctttgggtgtagattgctctgatgcctctggttcagatttttcttgattcttatcaaaatgatgagtatttaagaaacctgaccgcacctctggccactcttcaactgtaacataaactaccttaaaatcggaaccagttaacttagctaaattttgttgaagttcagtacgaagcacttcattatcgacagccttttcaaacagaaagtcgtaattgaacgctacgaccaccccttctttactagctgcaactggcttagaaacgtgcatcaaagcccgttctgtaacagatagcatatccattaagtcgcgccagagttcctgcatcgtatttaaactggccttagtagcattttccaagatcggataaatcttagttaaattagccggagttttaacttgtttagcacctatcgcttttttcttaggtttaggctgagctgattgtgaattacttggcgtattttttacattttgttgtagcttttgaattgcttgttttaattgactgacttctgaacgtaactgctccacttcttggttatccacggaaccggttggggcttcggtggaaactttcgcagtttttcgttgtgatagcttaatcgtcaaaacttccaaatagacatctgggtgggtcgtgaaacgcatttgttgctgaatactattcaatgtatcaatcatttgatacagctccacgccagtcaccatagctgcttcttcagtaaaagcttccgatagatcattcaagctttgttcttgcaccaactggggatcttcttggtataagagtaaatttctttggacagtaattaagtcttcaattaatcgttgtccatctttaccctcatctaaaatttgatgcaaagtttctaatgccgctgatgtttcttgcttaaaaatttgcgttaaatactgatctaatagcgtttggttaacacttcctgtaactaataaggcgttatctaaagttacttcttcgttaccaaatgagatcacttgatccaaaatacttaatgcatctcgcatcccaccttcagcagccttggcgataattgctaaagccttttgatcgtactggattcccttttgatccaaaatatagaccatgcgatcataactttgagctggtgtaattcgcttaaaatcaaaacgttgtgttcttgaaataatggttaatggaatcttttgaggttccgtcgttgctaaaataaaaattacattagctggtggttcttctaaagttttcaacaacgcattaaatgctccggttgatagcatatggacttcatcaacaatgtagactttgtagtctgcttcagttggagcatactttgccttatcacgaatatcgcgaatttcttcgacaccattattcgaggccgcatcaatttcgattacatcgtttaaggttccctcagtaatcgctttacaagtcacacattcattacaaggctcaccatctttgagatagtgacaattaaccgccttagcaaaaatcttagctgccgatgtttttccggttcctcgtggaccagtaaatagatacgcatggctggtctgctcagttattaatgcattttttaaagccctcgtgacgacgtcttgaccgaccatatcatcaaacttttgaggccgccaaacacggtataatgcttgataactcatttgatttccttccatatttgcttttttaagaaaagaacccttagcccaatggactaagagttcgttaatttacccaataacttaaggcacaagccagagcatacttagtgctgcttccttccggacctgacacaattcgtaagtccaaccttgcctcaaggccttacggcaataactatgatactcgaattttaaaaaaatttccactattttacttagttttttttcttctttttcgaatttctttaaaaaacgtcttcattaacatcgatgctcggtcagctccaatcccttcatgaaccgtcacttgatggtttaaacgcgtatcttcgagtacggtatacaggcttcgaaccgctcctgctttaggatctcgagcaccaaaaaatacttgaggtaattgtgaattgatgatggttccactacacattaagcatggttcaatggtcacaaaaagctgacaatcccacagccgccagctttttaaataagcgcaagcttccgtaatcgctaagacttccgcatgagtggttgaatcctgtgagtgttctcttaagttatgaccacgaccaataattttaccatcatgaacaaccactgctccaatggggacctcatcaatcattttggcgaattgggcctctttaattgcttcattcatataaaaattaatttcatgctctgttaacttattcatgtgcacttcttaaaatataatatcctttattcttttttaggacttcgacattcccaaaggtttcttgcattaattttttagctgagggcgccccctgttttttctgaagaacgattaccagttggccacctgcttttaaatgagatttagcctcaacgataattgtctcaactaccgattttcctgcacggactggtggattagaaataatcgtggtgaaatccgtatcatcgatattctcatatgcatctgatttataaatttgagtctgtttttcgacgctattagcaactgcatttcgtttggcgagtcccaacgcgcgttcgttaacatctgtcatctgtacttgtatctctggaaaacttttggcaagtgatatgccaattggaccgtatccacatcccacgtctaaaatcttttcagcagaacctgcaatttgtattgcttcaagcaacgtcctagttccaaaatcaattgtgttttttgaaaaaacaccgcgatccgaaataaaatttaatttatgactcaaaagctcgtagctccaatgcttctcgtcatgttcggcgttgggattttcagtaaaataataatctgtcattgaaaagtcctccattctctattaatataatatcgtattgtaaattcagttaccaatttaaaaagaataaaatttaataaacaccgccagcacaatatatagtgggattgtaaaaatatatcctctacatattgtgcttttttatttcaaatttagtaataaatgttgtatacttagttccatgataaatgagacaagggggatcagtattatgagaaaaataattgtgtacactaaaaataactgcattcaatgcaaaatgactaaacgcttcttatccgaaaacggggttacttttgaagaacgtaatatcaatgcaaatccagaatatatcgacactttaaaagctaaaggcttccaagccgtaccagtcgttcaattttctgaagaaaaagctgtggctggttttagacctgatttactaaaaaaattagcaatttagttctccaccaacgctaactcagatgttcaagacgccccattcgtacattgtaaatgcggagcgtttttttatttcacttgattgaagagaggattcgaattatgactttaaaagatctaaaagatgttacttactatgatttaaacaatgaaattaacatccctgttgataaccaaattcccctaagcaaggatcgtgaagctctagctgcatttctaaaagagaatgttcaagctaacaccatgcaatttgattctctacgtgaacgtttcgattacctcctcaaagaagactatatcgaggctgccctcgttgaagaatattcattcgattttatcgaaaaactgtacgacttcttaaagcaacaagacttccactttcaatcgtttatggcagcttataagttttacgctcaatatgccttaaaaacgaataataacgaatattatttagaaaacttcatcgaccgcgtggctatgaacgctctctactttgctgatggtaatgaagaattggccatgaatattgccgatgaaatcattcaccaacgctatcaaccagctactcctagttttttaaatgccggtcgtaagcatcgaggagagttagtttcatgtttcttaattcaagctaatgacgatatgaactcgattggtcgtacgattaattctgctcttcaactttctaaattaggtggcggggtcggaatcaacctcactaaccttcgtgaggcgggagcaccaatcaaggggattgaaggcgctgctagcggtgtggttccggttatgaaactactagaagatagtttttcttatgccaatcaattaggacaacgtcagggagctggtgttgtatatctaaacgttttccatcccgacattgtatctttcctttcagctaaaaaggaaaatgccgacgaaaagatacgggttaaaaccctctcacttggtgtagtcgttcccgataaattttatgacctcatcaaacacgacgaagatatgtatctatttagtccttatagtgtggaaaaagtttacggtgaaccttacgcctacgtcgatattactaaagaatacgacaacatggtcaaaaaccctgctattaagaaattcaaagttaaagcccgtaacatcgaaaatgaaatttctaaacttcaacaggaatctggctatccttacattgttaacgttgatacggctaatcgagaaaatccaatttatggaaaaattgtaatgagtaatctctgctcagaaattatgcaagtacaaactccatccgtaattgataacaagcaaaactatacgaaactaggaactgatatcagttgtaaccttggttcaacaaacattgttaatatgatgcaaacgccccacttcggtaaatcggtcgaaactatggttagagcactaacttttgttacggatcattctgatattgacgttgttccttctatccaaaatggaaatgctcttgctcataccattggtcttggagcaatgggactccatggttacttagctaagaaccacctttactatggtgaagcagattcgattgaattcactagtgtttactttatgctgttgaactattggactctaaaagcttctaaccagattgccaaagaaaagaatcaagttttccacaactttgataaaagcaaatatgctgatggttcttactttgataaatatgtagaaaatgattttggacctaaatccaatcgagttaaagagttatttaatggaattgaaattccaagcgttgaagattggaaacaacttaaaactgatgtgatggctgaaggactttatcaccaaaatcgaatggcagttgctcctactggttcaatctcttatatcaacgatgcgacagctagtcttcaacccattgttaacaaaattgaagagcgtcaagaaaagaaaattgggaaaatttacttcccagctccatatctttccaatgatacgttaaaatattaccaatcagcttacgacattgatatgcgtaaagttattgatatttacgctgctgcccaacaacatgttgaccaagggatgagtatgaccttcttcatgcgttcaacaattccagctggaatttatgattggaaggaaggccgcactgataaaatgaccactcgtgatcttaatatccttcgtaactatgcccatcatgaaggtatcaagtccatctactacgttcgtaccttcacagataatgatggtgaagttggcgtaaatcaatgtgaaagctgttcaatttaaataagtggaggattttttaatggaaaactatgaagcaatcaactggaatgccatttcagaccaaattgataaagctacttgggaaaagttgactgaacaattttggcttgatacccgtattccaatttcaaatgatcttagtgactggcgtgaattagacgaagaccacaaatgggtcgtaggtcacgtatttggcggtctaactctgttagatactcttcaatcacaagatggaatggcagctctcagaaaggatattcgtactcctcacgagacagcagtgttaaataacattcaatttatggaatcggtccatgctaagagttattcatcaatctttgagactttaaatactccctctgaaattgatgaaatttttgcttggagtgattcagaagaattccttcaaaataaaactaaacgaatctatgagttatatcatgatgatgaacatcctttgaagaaaaagatttcgagtgtatttttagaaactttcttattctactctggtttcttcacccccctttattacttaggtcataatcaactaaacaatgtggctgagattattaaactaattcttcgtgatgaatcagttcatggaacttatattggttacaaattccaattaggccttaaagagcttggtgaaaatgaacagcaagaaataaaggattggatgtataacttcttatacgatttatatgataacgaagaaaaatatgttcatactttgtatgaccaagttggttggactgatgaagttcttaccttcacgcgttataatgctaacaaagccctcatgaatttagggcaagacccattgttccctgatactgaagctgatgttaatcccatcgtaatgaatgggatttcaactggaacttctaaccatgacttcttctcacaagttggtaacggttatcgtttaggtaatgtggaaactatgagtgatgaagattacaacatttaaatccaaataaaaaaatccaacttccattttagaagttggattttttgtaacgctctgtcatcctatttatcaaaaagtctttatttgaatattttttaaaacaaaaaaagagctatttccatccaaatggaaatagctcttttaataacttaagaaattaaattacttaacttctacagttgcgccagcttcttcaagcttagctttaagttcgtttgcttcgtcttcagaaacgtcttctttaattacagaaggagcgttgtctaccatgtccttagcgtctttcaagccagcacctgtgatttcgcgaactgctttgataactttgatcttagctgaaccacctgaagtaagttcaacgttgaatgaagtcttagcttcagcagcgccaccagcagcacctgctgcagcaactggagcagcagctgaaacgccgaattcgtcttcgattgctttaacaagatcgtttaaatcagtaattgaagcaccttttaagtcttcaataaattggtctttatctaatgccatttttgtttcctccaaattaattataattaaatgttatttgcttatgcagcgtcttcttcagacttcttgtcagcaacagctttaagtgcatatgcaacgtcacgtacaggtgacataaattcattagcaagcattgcaagcaagtcttcacgactaggcaatgtagcgaatgtattaattgtatcgatatcagcaacttcaccttcaataataccacccttaattgaaaggttgtcattactgtcagcaaaagtcttcaaaatcttagcaggtgcaacagcgtcttcttctgagaaagcaacggctgaaggaccaacgaacacgtcgtccataccttcaaaaccagctttttcagcagcacgtgtcaacactttgtttttgataacgcgtagcttgataccagcgtcacgaagttgtttacgtaagtctgttacttcagcaacagttaaaccacgtgaatcaacaacaatagcagaaacggattcctttaattgttcagcaacttcatcaacgattgcagctttttgtgcgatagcttctttactcaatgtatttcacctcctgaatgattgttgaaccataaaaaaattcgtaccccagaaagactctgagacacgaatagtttcatacgttcctcggcaggcaatatattaaggccaaacctggccacctgagtcttaggtaaattattcagttataattcactcttagtaatatatcacagcgtttggaacaaatcaagagattttagaattgagaaaagtcaaccttaactcctggtccaaatgttgatgcaactgatacgttttgtacgtaagcacccttaacagatgcaggacgtaaacgaacgattgtatcgttgattgtttgtaagttaccaagtaattggtcaacatcaaatgatactttaccaattggcacatgaacattaccgtcacggtctgtacggtatgtaaccttaccagacttagaatcagcaacagccttttcaacatccatagtaactgtaccagtcttagggttaggcattaagttcttaggtcccaatacgcgacctaaacgacctacttgtcccatcatgtctggtgttgcgattgcaacgtcaaagtctaaccatccgtcttggatacgttgtactaagtcgtcgtcaccaacaacatctgcaccagctgctttagctgcttcagccttagcacccttagcaaatacaataactgtttgttctttaccagtaccgtttggtaaaacaacggcaccacgaagttgttggtcagcttgctttgtgtcaacgttcaacttgtatactgtttcaacagtagcgtcgaactttgcaaaatcaattttcttaactaattcaagcgcttcttttggagcataagccttaagagcttctacttgttttgcagcgtcttgaaactttttaccttttttagccatctgtgtgttttcctcctagcaaatgtggttatagcggattttcctcccactttgatacatccactttagtggagtatccgacagtgcgtgtattagccttcgactacgaatcccatactacgtgctgtaccttcgatcatgcgcatagcagcttcaacgtctgcagcgtttagatcttgcatttttgtttcagcgatttccttaacttgagcagaagtaactgttgctactttgttcgtgttaggttcaccagaaccgtgttctacaccagcagctttcttcaaaagaactgaagcaggtggtgtctttgtaacgaagtcgaatgaacggtcttcgtaaactgtgattacaacaggaattaacaagccagcttggtcagctgtacgtgcgttaaagtcctttgtaaatcccataatattgatacctgcttgtccaagtgctggtccaaccggtggagctggagttgcttttcctgcaggaatttgcaatttaacaatgtttgctactttctttgccacgagacatacctccttaaaataagtccgtgtgtggtcacgatgaagatttatatttcttctcccacattgagtatgcaaggcatactacgatataataccacacccgaaatgtttgttcaaattaaaatctagtcaattttatcaatttgttcgatatctagttctgtactagtttctcgaccgaacatatcgatgttaactttaaccttcatgttgttattatcgacttcagtaatcttaccagtcaaaccttcaaaagcaccgtcgacgatcttaactaattcgcctacttcaacttcgatatcagcatgacgagcagtcattcctaggcgacgaagaatacgttcaacttcatctggtaaaagtggagttggtttactaccagaaccatgggaaccaataaatccagtaactcctggtgtattacgaaccacgtaccaagaatcatcagtcataatcatttcaaccaaaacatagccaggaaattcattcttcttaacaatcttgtcttccccatttttagtttcaacttcttcttcttcgggaacaactactcggaaaatatattccgccatccccattgatttagcacgtgaatccaagttatttttaactttattttcatatccagaatatgtatgtaacacataccagtttttttcttcagtttccaagttaagcgctccttttccaaaataaaaaaactccgtaagcacgaagtttctatcaacaaattaaattataacaaaataatcgaccttatgccattatacaaatagcttaaggaacaattgaattagccaatcggctaaagctaagaaggctataaaaaataccgatgttgaaataacagtggaagagtcttttcttaactgtttaaaattaggccagtcaacttctcgcatctcttgaccaatgctcttaaaaaatcgaaacatttaatacgcctcctatcttgtttcactgtgtaaagtgtgtttgttacaacgtttacagtacttattaacctctaaacggtctgttctttgcgggttagctgctactgtgtagtttcttgaaccacaaacagtacatgctaaagctactttcttttgggacataaaaaatccctccttatcgaaattaaactttagcatgtgcaaccctgattgtcaattaagggcgaccatacatttgttcacttaatttttgtttacaccgtactatcgcattttggatcttaatcacctcataaccaagtttttccgcaatttcttctgggcaatttcctttaaacaacagcactgaaacttctttttcaaattttgataacaatgattcatattccgcataactctccttaatgactaaattactatgcggtgtaatcttagaaattttcttagttgctgtttctaaatcaccatcaacactttctatcgattgcgccgtcagacccgcttttcttttataggccatctcaaatcttaagatactataaattcgattagtaaaattagttcgaaaaaaagcccccaaagtaatttttaaattttcatcaaaattaactaccgagttgaagaaaacgatgcgtccttcttgcaaccaatcatcccattctagattacgaatcgaatatcttgttcttaattttttaataattggaatatatcgcttaaatagaatttcaaaattacttgaatcattgttttttatttgttgaactatttcaagctcatccaattcttccaaactaccttgtttcgccattacgcttcctccctgtttcaatggaaacgatcttagcaaggttgttaaaattttctaaccgcatttttcgtaaataaaaaacgaataattggcattccaatcattcgtttctaatttttaaagttgatgtcttgaattatagccttggtaaattaaaagtccggctgctacacttgcatttaaactttgaatttcaccaaccatcggaatcgttaacatttcgtccacattatccttagttaggcgggccataccttttccttcgttaccgataatcaaacctaccgccccttttgcatcccagcggcgataatccgttcccttcatatcagtaccaaaaatccaaagtccacgttctttaagttctttaatcgcgttaactaagttgctaacttggacgacaggaactcgttcaattgctcccgcagaagttttggctacggtactggttaaaccaactgcccgtcgttttggaataattactccgtgaacgcctgctgcatctgccgttcttaaaattgaacctaagttatgcgggtcttcaattccatctagaattaaaatgaagggttcctcttcgcgtgctttagctaacttgaagatatcatctaattcagcatattcaaaggatgcaaccgctagtaccaccccttggtgattttgtccgttcgataatgtatccaatttcgacttagtaactcgttgaattaccagaccttgtttttttgctttagcaataatttgtccaattccatccgattttagcccttcttgaataaaaaccttgttaattgaatgatcactttgcaaactagccattgctggatggcggccaatgacaaaatctggttgttgcgtttcatttgaattattcaatacgtaaatttccttcctcgactttttcaatacaccattgagcaaattcagctaaacgttcagtttgattcgtcaatgatagatatccaacaattgcctcaaatcccgttgaaattcggtaagtaaggactgatgtgttttttgcagacgtatgacttttagcattacgcccctttttgaaagcttcgatttctttttcagtaagaaaattttctgcttccattgcgttaattaaagctgcttgtgctttagcagatacatatctggttgcaacgtgatgtaaccgattaggccgggtgagcccctgtttaattagatgtcttctaataaaaacttcgtactccgcatcacccaaataagctaatgcaattccattaattgcttggtaattaaactcttcactcatctttttttctccaacgtgttccttgtggcgtatcctctaagataacacccatttcttttaattgattacgtaatcgatcactagtctcaaaatcgcggtctgcacgagcttgatcgcgttgtttaactaattcatcaatttcagcatcatcattttcaatctgtttcaattcaatcccaaaaacagctgccattttagcatagctggttaataattgattaatttgctcagcattcacggctgttttttcactatatacattgattaagcgcgcaaactcgtaaacaacggtaatcccattttgcgcattaaagtcatcatccatcgctgtaataaagtctgtttctaattgagcagcctgttcagcaaccgttgcgtcagctgccccttgagcaccttgcaaacgataattcaaattgataaaagcattttgcagcttttctagattgtttttagcgtcttgtaaacttgcttgtgtatattgaattgggcgtcgatattgagtagtcgacattaagaaacgtaagacttggggatttattttttgaactaaatcgtgcaccgtaacaaagtttcccaaagatttactcatcttttcattatcatcaccgactgtgacaaaaccattatgcatccagtatctagcaaactgtttaccagttttggcttcactttgagcaatttcattttcatgatgcggaaattgaaggtcttctcctccaccatgaatatcaaaagtatctcctagatatttggttgacattactgaacattcaatatgccatccagggcgtccgatcccccatggtgctttccaagcaatttcatcacccttagctgccttccacaacgcaaaatcaattggatcttctttacgagctgtttcttcatcatctacgtgttggctcgcaccctgttctaattcatcaatattttggtgcgaaagggcaccatactttgaaaacttacgtgcccgatagtatacatcgccatctaccgcataggcaaagcccttgtccatcaaatctgcaataaatgcgataatatcatcgatattctcagtagcccgtggattaagcgtcgctggttctacattaacagcttggacatcttctttaaaagctccaatataacgatccgctaattctggaactgtaataccttgttcacgagctgaattaatcattttatcgtcaacatcagtaaaatttgaaacaaatttcacttcaaatccgcgatattcaaaatatctcctgatggtgtcaaaggcaataatactacgcgcgttgccaatatgaatatagttgtataccgtcggtccacaaacgtacattgataccttatgatccactaaaggcttgaaagtttctttagttctagacattgtattataaattttaatcattttttcactccctacggggatttttagctacctctaatgataattgaaaagagtatgcaacgcaaagtgaatataaaaaagaagagcttcaaaaaagttttagtcgctgagccaagcatcaacgtttggtagcggagtccatgtctcccacctaactttattgaagttcttctttcatatttagcttaattcttcaatcattgcccgtaaatgttgcattgataattcataacctaataattccaaactttctggaagttctggtccatgcatttcatgggtaatagcaattcgaattggcatccaaagtttgcgacccttaattccagtttccttttgaaccgccttaatagctgccaaaatgttaactgtatcaaagactggcaaatcactgaattgtttttccaatgcttttaatactggaagagcatcatccgtggccaattcttctttagcctcttcatcgatattttcaggaccattaaagaataattctgtaaattcaacaatttgcgctgtataactcatttgacgcttaaataagttgattaacttacgtgcccattctaccttcattggtgctgggttcttttcaatcttaccggcattaatcaattgaaggagtgctgagtgcatgatacgatcttcatcagcagctttaacatattggttgttaatccattccaatttcttagcatcaaaagcagcaggtgacttactcaaacgcttttcatcatacatcttaacgaattcacgtagagtaaagatttcactttctcccactggtgaccagccgagcaagataataaagttcaacattgcttctggtagatatcctaaactacgatattgttcgatgaattgaagaatagattcatcacgtttacttaacttcttacctgtttcagtattgataattaagctcatgtgaccaaattggggagcatcccatcctaaagcttcataaatcatcaattgtttaggagtatttgcaacgtggtcatccccacggaaaacatggctaatttccatcatgtgatcatcaacaactaccgcaaagttgtaagttggcattccatcacgcttttgaatgacaaaatcgccaccaattgtttcagattcaaatgaaatatgacccttaaccaaatcatcccattcgtaagtagtgttggtaggcaccttaaaacgaattacaggttcaattcctgctgccttagcatcagcaattttttgttctttttgttcaggtgataatccagcatattcatcaacataatgaggcatttcaccatttgccttttgctcttcacgttgagcagctagttcttcttcagtcatatatgattcatatgctttaccttcagcaactaactgatcaattagtggttgatatatacctttacgttcagattgacgataaggaccgtattctcccggtttatcaggaccttcatcccaatccattcccaaccattttaggttatcgatctgacttttttctccgtcagcgatattccgactttggtcagtatcttcaattctaagaataaatttacctttgtaatgacgagcaaacaaataattaaataaggctgttcgtgcatttccgatatgcaaatgtcccgttggacttggagcataacgtactcgaatcttttgctttgccaaaattaacacctctccaaaaattatgtcacaatgttttcattctacattgatatcaataataaataaagtctattctgtcttatctttgctatgggtaatttccttagtggagtgaaccggtttagcaaaaatcattcgacccgcatcagtttgaattgcgctcgtaactacgacgtcaattgtttcactgatataaaacttaccatcttccacaacaaccatcgtcccgtcgtccaaataggcaaccccttgttgacgttctgtaccattcttaacgacgtgtactttcatcgtttcacctggaattactcgtggtttcaacgcattagccaactcgttgatatttaatacttggacattctgaaattgactaactttattcaagttataatcgttcgtcacaattacggcgtccttgtccttagcaagttggattagtttgctatcgacttcttcaatttcttcataatcgccatcgtacatttcaattggcataatcttttcattttgaagcttgtttaagaagtctaagcctcggcgtccacgcacccgcttgatgctatcagcagaatcggcaatgtattgtagttcgtataagacaaagttaggaactaataaagttccctctaacaatccagtttttactaaatcgtatactcgcccatcaattaagatattagtatctaaaatcttgtaatgatggtaattttcacctgctcgacgctccaacacttgatcttgattatttaaatcacgtttgcgaacttggaataattttttccattcgtttagccgagttgttccaattcgaaaacctaaataacccaaaatcaacattaaaattaatggaatcatcgtattaataaagaagacatctgatcgataaaataaagtggaaattaaaatagcaatgaccaatccaatgaccgttccaacaccactagtaattaaatagattggcgaagatttagttaacattttttctgctcgtctcattaaactcaatacataaccagcccaaaagatagatagaacccagaaaataattgcaccaataacaaagcccgttacgcgattgtttaataaaataaacttatccaaatttgataatgaccaaacaactggtagatacgacattcctaaagtaccaccagctaaagcaaacaccgcttggacaattcgttttttaatatttttcattttaattcacctcctttctaattaaacgccttccgaattgcgtccgtaatcgttgttactcctactacttcaatccctttaggtggattccaacccttcaaattattcttaggaattaaaattcgttgaaaacctagtttttgagcttcggcaacccgttgttcaatccgattaacccgtcggatttcaccagttaaaccaatttcgccaacaaagctatcagccggtctcgtcccttgattcttaaaactcgatacaatactcatcgcaattgccaaatcaattgctggctcatccaatttcactccgccagcagcctttaagtaggcgtcttggttctgcaacgttaaattagcccttttttctaaaactgccataattaatgagactcggttacgatccaacccgctagcagtccgctgagcattcccaaaaatggtaggcgtaatcaaagcttgaatttcgaccaaaattggtcgagtaccttccatcgaaaccacaatagcggaaccgttagcatcttgcaggcgttcctctaaaaagatttccgaaggattggctacttctcgaagcccttcctctcgcatttcgaaaattcccaattcattcgtagaaccaaatcgatttttaaccgctcgtaaaattcgatacgtatgatgcaaatcgccttcaaaataaagtactgtatcaaccatatgttctaaaattttaggaccagcaatggctccacctttagttacatgaccaacaataaaaatagtaatgttatttgttttagcaatctgcattaattcggctgtaatttctcgaatttgcgatacactacctactgctgaatcaatgtcgggctcttgcatggtttgaacagaatcaataattacatactgaggatgtagttcctcaatgaccgcacgaatattggacatatcagtttcagggtataagtaaaaacgttcactgttaacctgtaaacgttcggcgcgcatcttgatctgtgaagcactttcttccccagacacgtataaaacatctcgatcagtagcagctaattgcccagatagttgtaataatagggtcgacttaccaattcctggatctccaccaattagaactagtgagccatctactactccaccaccgagtactcggttcagttcttccatccctgttttaactcgcggttcttcgtgcattttaacttctgaaattaattgtggtttactacttttaccctcaaaactaacgcgactcttacgttcatttttaggttcactaatccgctcttcaaccagagtgttccatcttccacaattaggacaacgtcctaagaatttaggtgaaacatacccacattctgaacacaaaaactgtgtttttactttagccaagctttaaatcccccctcaactttaaattcgtacaattaggatagcatttatttctataatttaatcaaaattagtttgacctttattgatttttaatgactacttagtcgaaccaaacccaccagttcgcttttgttctgaggccgtttcgttgtcagctactaaatatttcataaaaattccctgaccaattcgttcgccctttttgatttttacatctgtaattccataatttacaagttggagaaaaatagccccttcattgctttcattattgtagtagtccgcatccacaattcctaccccattaggtaaaatcaaactacgttttagagggttactagaacgattggccaacattaaatactcatcatcttccatatatgctttaatacccgttggtactaaatatggttttaattctgctcgagccgcatctaatacttcgtctgttacattttcttgatgacgtagggcccacaaaaccttcacaaaattcaatttccaaatacttggcaacacaaaatcttctgccgcttcaaagtcatatccagcggctgcttttgtttgtcgttggggtaaatgtaatccttgattttgatacttactaataatttcaaatcctctactcattacggtttccctcctaataatcatttattttattatccttttattgacccactttgtaaacggaaatctgttgaagcaattgactttatgcgctttcttggcgacaatgattattgtaggaaaaggaggcttatgtatggaaagaaatatcgaagcaaaccgtcttttttggactaattccgaaggtgtgcaagtaggacatgtgctctattctaaaattcccgatcttgatactttaatctgtgaagaagtctttgttaatcctgaagttcgaggacaaggctggggtggcaaattgatgaaagacttcattaattttgcaattgaaaataaccagaaaatttatcctctttgtccctttgcaagaaaatattttctcaaccatccggaactttccgaatggaacatgcacgaccaaattacagcaactaaaatacaaagcttagtaagtcgaaaggaagattaagaaatggatcaaaatgaattaaaaaaactagttggcgaagaagccgttaaatttattgaagatgggatgactgtgggtttaggtaccggttctactgttaaatttatggtggacgctcttggtgaacgcgttaaaaatgaaaatttaaatatcgttggggtcccaacttccgatcgtacagctgaacaagcccgttccttaggcattaatgttaaatctgttgacgaggttgatcatattgatttaaccattgatggagctgatgaaatcagttctgacttccaaggtatcaaaggtggcggtgccgctcacttgtttgaaaaaattgttgccacaaactcaaaaaaagtaatgtggattgtagatgaatctaaaatggttgatcacttaggggccttcccactccctctagaagtaattccatatggtagcaaacaagtcttcaagaagcttgaaaaagaaggccttcatcctgaatttaggaaaaatgatgctggcgaatatgttttaaccgattctaaaaactacgtaattgatcttcatcttggtgaaattaaacacccgcatcaattagcagattatctaatcaaacaagttggtattgtagaacaaggattgttccttgacatggttaatactgtcattgttggacgccaaaatggtccagaagttttgactgctcgaccataattctaatcatttactaatttttttaattagcgtataatcatcaccaatattaggatggagttgaagatattgagtaaagaaatttcacaaaatttaattgaccgttttaaacaagaatataacggtcgtaaagaagctaaagttattgaacgcacagttactaaaaatggaattcttaattccagtcgtaaccttgcagctgatgttcaaagcacacccgttttttcaattgatttagataccggtgatgttgcgaatcagaaacaaagtggtcgttgttggatgtttgccgctttgaataccatgcgccatgacatgaaaaaccaattcaaagttcctggcaattttgaattatcccaaaattatacttttttctgggataagtttgaaaaatcaaattggttctacgaaaatatcattaatacggccgagcttgatactgatgaccgtaaagtggccttcttattaaatgaacctcaaggtgatggtggccaatgggatatgctttgcgcattaattgaaaaatacggtgtagttcctcaatcggcctaccctgaaacttataatagttcaaaatctcgtgaattcgacacattgttaaatgaaaagttacgcaaagatgcagttacattacgtaatttagttaattcaggagcaaatcgtacagacattgatgaacgtaagcaacaaatgcttagtgaagtctatcgcatggcttcttacagtttcggagaaccacctgttcaattcgattgggaatatcgtgacgctgatcaaaattatcatcgtgaagcaggtattacgcctaaagcattttatgataagtatgtaggttggaacctttccgaatatatttccatcattaatgcgccaactgctgacaaaccttacaaccaaacatatacaattgatatgcttggcaatgtcgtaaatggacgccaagttaaacatctaaaccttgctatggacgacttcaagcaggcggccatcaaccaacttaaagctggacaatcagtgtggtttggttgcgatgttggtcaacactctgaggctcgtgaaaagggacttttggacctagatgtttttgctgaagatgagttgtttgatatcgatctttcaatgtctaaagctgaacgtttagactacaaagagagtttaatgactcacgctatggtacttactggtgtcgatcttgtcgatggtcaaccaactaaatggaaagttgaaaatagttggggtaaaaaagtcggtgaaaaaggctatatggtaatgtccgatgcttggatggacgaatactgttaccaagtagttgttcaaaaacaattcttgaccgaagcgcaacgtcaagcgcaggctcaaacacctaccgttttgaaaccttgggacccaatgggatctttggcttatcaagattaataaataattttatcaataaaaaagcgactagctgtggaccaaatgaaaatcggtccttaactagtcgcttttttactactccatatttgaaaagggatgtggatcgttatcaataatttctacactattaccttgtttttgcagacgttcaaccttatccttaccccaatttgacattgctaataaaatatttcttagactttttccctcttcggttaaagaatattcaacctttggcggtacctggttgtacaccttacgttgaacaatattgtcggcttctagttcgcgcaattgcctagttaatactctttgtgaaacgtccggcatcaactgacataactctcccgttcttagagtacgacctcctagatgacatagaatgacgggtttccattttcctcctattacatctaaagttgcttcaactgctacatgatatattttttcaggcatctaaccaaacctcctactgggtaattttagcacgtccttttggaacgacagcattttctaaaactatttctgacgtttattttcaaatttattttctaccaacatcaataaaactgctaatgcaaccatagctgctgctagtagcattgtgcttcttaagccataagtatcaagtgcaactcctcctaagaaagacccacctacaatgccaaaactaaatgcagaaatattcaaggatgaggcaacatcaactgctttagatgaataacttttagctaaaattaaaatatacgactgtagaaccggaacgctcataaaagcaactaaacctaagagcacaatatttaaagtacttaaatatatattagtaactgtaaaataaaaagcaaataaagctaacccttgaacgatgaagatcccgaataaagcgttaatcggtttagcatttcctagtttaccaccaagcgtatttccaattgcgatagctataccataaatcactaagaataaactaacttgattcgcagggacatgggttatcttttgcaaaattgatgataaatacgtgaaggttgcaaaagtaccaccatatcctaagatggtaattaggagcgttaataaaacatgtggatgcaaaatcaactttacttgatctgctatgctggatatttctacattctttctagcttgtttaggtaaagctactcgatttaaaatccatgctactattcctaaagtcgcaatcgccaaaaaaggtatccgccatccccaataagtactaaccgccgtccccaatggagcacccagtgctgtcgcaattgtgaaacccgtaaaaatataagcaattgcactcgcttgtctggattcatcaactaattcggcggctattgtcgaactgagcgcaaacaataacccatgtgaagcaccagctattaacctgccaaaaatgacttctccaaaattggtagcaaatccaataattaagtgaccgattataaaaataataatagcccctaaaatagttcctttccgctgaaatttagcagttaaaattgttaaaattggagcacctaatgctactcctaaagcataaatagtagttattagtccggctgtcgaagtcgtaatcataaaactttttgaaattgctggtagtacccccacgctaataaattctgtgacaccaaccgcaaaaaatattactgccaaagcaaataaagcaaaattagctttagatttttgattaatcattatctcacctcatattttctctctcaaacgatatagataatataagtgaattatgacatttatagaagtacgcactattttgtcgcatagagacaaaattgtcccattttactgaaatcaatactttatgcataaaaaaagagcctaaataattaggcttctttcaagataattttattttggatggataaatccgattttaattcgtaaatgatgggttctccattttcaacttcgactccgtcaataccctggtcagaaatgttctccaaatatttaattaatgctcgcaaagaacttccatgtgcgactaccaattgattttgtccttccattaatctaggagcaatttgatcaatccagtatggtagcaagcgattataagccatatgtaaactttcacccagtggttcattcaaaattccattaaccgcatatcgtcgatcatcatcgggatgctctagcaggggtggtactgcatcaaaactccgacgccataaagcaacctgctccttaccataaatttggcgggtctcatccttattttgtccccttaaagccccataatggcgttcatttaatcgccaagtcttattaatcggtagccaattttgattaagatcatctaaaacgatattagcagtcacaatcgcgcgcttcagcattgaagtgtgaaccatatcaaaattaattcctaatttagcaattaattttcctgctcgttgtgcttgcttaataccaagcggagtaagcggaacatccgaccaccctgtataaatattatcacgattggcggtactttccccatgcctaattaaaactaatttagccaattcttttctctccctgctcaatattaattcaatcttatcgttcaactctacttcattgttattcattttctaactagttgcaagtcttaatcccattaaaaatttttacatgaagatactaaaaaactgtggtccacattacgaaccacagtttagttttaattccaatgattaaattctaatcaacatacttccatagtccagacccgcaccaaacccagtcattaaaactgttttaggattaggatctttttcttggagttgagccaatgccattggaattccagctgatgaagtatttccatattgttcaacattcgtaacaaatttttccattggaatgttaatcgtttcagaaatcttttcaataattcttaagttagcttgatgacagattacgtaatcaaccttatcatgtaaatcatttcgatttaaaatttctaccatttgaggaggaactactccggtagcaaaactaaaaacatctcgtccactttggaaaaaagcgtcgattgttggaaagttattagctttcacagccgttaaagccggaattcggccgctatgaatatactcatttttttccgctaaggtggctaattcttcgtcaataaagaaatcttctgtgttatgcgcatcagcagaaataattacaccacccgctccgtcaccaaaaaatactgcggaggtccgatctttaaaatccatcattttagaattggtttccgcactaatcaccatcgcgtttcggtaacgtccagaacgcataaatttttcagccgtacttaaaccaaaaacaaatccagcacaagcagccgatatatcaaaagcaatagcatttttggcgcctaacttagcttgcacaatggttgcagtagccggagttaaagcgtctggcgtaatcgttgaaagaataataacatcgatttgatcagccgttaaaccactttcgtttaataatttttgtcccacttcgactgctaagcttgatgtattctcttcgcccatggcataatgacgagtttgaattcctgtgtgggattgaatccactcatcatttgtatccataattttggataactcatcgttatcaaccacccgttcgggtacataatgtgctgtagataaaatttttaaactcattttaagcttcttcctcactttgtttatcattctattctaccagtaaaatattatttgtgaaaatagtgtgcgtgacagatcacatctaacaaacgttttcattgttgtaacaatcggattaattaagttcttataattatattaagaaatctaatggatctcatgtagaaaacttgccttttaatcgttaaataattatgcttaattaataagacaatggaacaatactggaggaatattaatgtttaatttttcaattagctggcttattttttggatgaaaggtcgcgtcgaagtggacaaccaatctgttcgtagtcgcatccctcgtctattactatgggttttcccttatgctctaatttctaaagacattgcactaagtgatattaaatctaccagcatcaaaggtaaaaatcagtttttcccgctactacttggtttaattttaattgttttaggagctttaagtgccatgaataaaggcttagcaatcggaattttagccatcattatcggtttaattctaggtattgccggattcaaggcccgtttaacaatcgaaactgccactggtcgttttaacattgacgttcctgcttctcaaaaagaagttttgtttaaaatagaacgagaaattcaaaatcgtcaaaaacaacccgaaccaaagattaaagaaaatcaggtgcttgaggaactttaacatttatttggaccataaaaataacccgtaactattaaagttgtgggttattttttattataaattatttttatctaacatttttatcaaatctttacggctatcattaggaattttttgagcgtacactgttaatccacgttcgtgtagggttcggattgtagcaatctcttctttaccaaccgcaatcgcatctgttagcatcgtcatatctacggcgtatgccaaactgcccacatcaatccctaaatcagagacatcgataccgccatcaaccagcttcaacatatcttgtagggtttccgttaaaagtaacactttaaaagaatcaaattgcgaatcttgataaattcgaatcattttttcaaccgtaatcacgtttactaatattccaggaggcgcagcttgagtaatcaacgttttacgtaaattatcttctgcaacgctatctgaaacgactaaaatccgattaggtttaacctttttagcccaagcagtcgctacttgcccatgcaagagccgactatcgacacgagccagtagaatgtccatcgtcatatcaccgtgtcctccaaaattaagattagttttaatctacctcacttaggattgtatcatttttttcttgccatgtttccaacaatttataaacataaaattcttcacttggagtcatttcaatttgaatccttctcaaatacttatcatccgctttttgtatcaatttaaaccacacttcatcctgaaccgcagccaattcttccggtgctgtttccatcggattattggtaagcattctttccactgctcccgcaatatgcataattaaattgatgcggaaggattcactaaattccactttcttagtttctgccaagtaatccacataattccataaaatatccgtgaacttatccgcattcaagaaaacaaagtactgtgataaatattgacgacaaacgctacgcgtcaatttagagtcttgttcatcaagcacccatgatacttcgctacgttctgccaactgtcgaacgaacttttctcctccaccctgtaaaagtgtttgaagaggcataaatggtactccaatttgtggattcattactccagtcgctgcgacaatcgtatatttggtgttaatttgttggatatgatcttgcatgtttactatggagatcggaaaaactttgatatcctcaattaaattttgaactaagagttgatctagtaaatctttaatttttttggcggttccttcacctgtggagcataccgcgacgatcgctttgggtttcccagaaatcatggatagatcttctgctctttcttcaacgttactttcatccgcaattgcaactctggagtatccgtgaaattcacgtagttcagcataaatatcgttcaaatcactatcgataaaagaagcttttctggtcgcttctaagaccatcgccgtcgttaccatatcaataactttaaccggaatttgagtttcttccgtgattttagatccaaaggtacttaaggatcccatatcaactagtagaagtactccttccccctggttagcagctcggacgcgttccacaatccccttatacgccgtttgcggattcatgtcgagcggcatatcaaaagcttgaatcgagttgtcagataataattgagagacgacttgtgtcatagaactagctgtactacttccatgagctgccaccacaataccgacttgaccattactagttgggaccgttcttagtgaaattaaaaggactgctaaatagtaactctctgattcaggaatcggcattccataccgctgttctagcatttccttaatcgatttagcaaccgccaactcttctggataatccttaaccattgcaactaaatcattgcccatcaaccgcatcggttttccagattgaattcgtttaataaatgaactaatatgcaaactcattgcatatataaagttctctttaaaatgataatctaattgattttcaatcttaggctgaacctgtttagcaaaatcaataatccctttatccacaatttcagctagtttactttctgcttgacgagtgtctgattcattcttatagaaagattttaaatgtaggttaatatccgtagtaataaaattattgatattttcttggtcaagaccctcttcacgtagcatcatcgctttatcgccaatgatttcatacaaattatagggcagttcatagctatctttacggctaacgggagttgcataagatgatcccggtttaattaccatgtagggttctagtaacttcgaaattgccccaagttcagcccggttagaggctaaatttagtaatccatccttaatatttgacggcaaatcatccgctgtaatcatgatttcgccttcattttcgatattgttcaaaaatcccttagcgcacactaattgaatattagattttaattgacccacatttccatacgtaacactacctaataaagcttggacaacatcttcggttaatgtaatttctttgttagttcggttggcttcaattgttaccaatgaacgtagaaggtcaattcgttcttccggactacgtttgttaaatgccggaagttgaatggtaattggaattcgacgaacaaaagtctgtagcaatgaactttctggatcttccgttgtagcacaaactaagcgaacgtcggcatgatggttcttggaagtttcccccaaccgattataagtaccatgatccatgaaatagaaaatcatttcttgaccttctggtggaagtcgatgaacttcatccaagaagagcatcccaccatcggcctcttgaatcaagccatcttgctcatcatttgcccctgtaaatgcaccttgaatgtaaccaaatagatgggacatcaataattccggattgtgtgcataatcagcacaattaaaggttaccaactgttgctgtcgatcaattaaacccttagtttgggcaaattcaaacatcgcattggcgaagtatgttttaccagaaccagtcgggccaataattaatgtgttcagtcctcttggtggatacaacatggctgccttggcttgttcaatttggttgtgcatgcttcgactcttgccaatcattcgatcaaaaatattagtatttttatttaaagtaaccggtcgagttggttcttcaagggtacctgctaatttcttcttccccaggtccattccactaataccatcttcaatgtgatagctagatggatcttgactggattgttggggaagttgtccttcttctgtcaaaggtcgacaataacgtacaggccgtccactaatcttggataacttattcttacgaactaattcatttagttccttgctaacattgcttcgagcgacgttcaggttctctgcgattaaactcgtcgttaacgcagcttgctcctttaattccgtatcggaaacattttgcgtattttcaataacatattcataaattctatcttgtcttttcattttctcaccgcaatctgtattaatacactaattaatacaatacagtttaacacagtttcaaaacaaacgctttcaaacaaaaaactatgctaaaaaactcatctttccgtccctcgtccaaatattttttagacttgctttaattgggtcgtttcaaatcgctttttagcatagttttaaatggttaattaattattatttagctttacgcttgaaaatgctcattactcctcgtttgattacgtcccaaacccctaatgaacgtaccatgcggtcagcatcaacatgttttctaatttctcttaaaacttcatgggtttttttagaagcgaaactataggttccacttcgtttagttttaatggcaaatcttggaatccatctacccccaaagaccaaggaagcaatcactgtatcaacttcttcccaaggaatttgaatgaagttttcaacattacgattgtcaaaaaattcaaaaccgtgatcgccaatcataatttttccgtaatcacccatccccaaaaatgaggtagcatcgattaccaaatctgcttttgtattaattgattgagccattcaaattactccattcttctttttatccaattataatacttaaggtacatttcaccaaaaattttaataaaaaaagcctaggccatagcccagacttaatttaagtttattacataacgtggagtacgtgaagtacaacaccaacgatgaataaaccaaagataacaacgataggagaaacacccttcttaagtaaccacatgcaaagaagtgttagaagtaatccagcaagtcctggaattaattgatccaagttatcttgcaatgttgtaactttttctggagttaatgaaagaccagcagcttgttgttgcaatgcttcttgaattcctttagcaccacttggaaggtttgcccagtcgatgtaagcacctttactttgtttaacagttgaaacaactggtgtgaacttaacagtaacccaacggttaatcaatgaaccaaggataaacatacccaagattgaagcacctttagtaacgtcttgtagtaaaccaccagacatgtcttctgtaatctttgaaccagctttataaccaaattcttgtgtataccatgtgaatcccatacgaatagcattccaaagtacgaagtaaagaattggtccaaggatgttaccacccaaagcaagtgaagcagctaaagcaccaataattggcttaactgtaaaccagaataccggatcaccaacaccggcaagaggtcccatcataccaactttaaccccttgaatcgcaacgtcatcaataggagcaccattagcacgttcttcttcaagagacattgttacaccaaggataggtgcagctaagtatggatgagtattaaagaattccatgtgacgtgtcaaagctgcggcacggtcttcttttgttttgtataactttttaagagctgggattaatgtatatgcccaaccaccattttgcatacgttcgtagttccatgaaccttgaaggaatgttgaacgtaaccaaacatgaatacgatcttttttagttaattgaactttttcttgcattttctgttggcctccttttagtatttatcaattatatcgccgagcggatcaccggaacctgagttgcctccgttacttgaaccacccatttttgaaagggttaagtagataagagccaatgcaataccgattgtacctaaagcgataagtgtcaaatcagggatagttgctaaaacgaaaccaagcgcgaagaaaggccaaacttctttagtagccatcatgttgataaccattgcataaccaacggcaacaaccataccaccaccaactgatagaccgtctgtcaaccaagcaggcatagcagcaagtaaactacgtacgggaccagcaccgattgcaagaatcaatccagctgggatagcgatacgtaaaccttgcatacagatagcaacgtagtgccatgcttcaagtttaccgaagctaccttctttagcagcagcatccataacgtgaacgataagagttgcaagtgtacgagcaatgattgttaataatagtccagctacagctaaaggaacagcaagagcgatagctgatgaaacaccagctttaccttggccacctaaaactaaaataatagcagaagctacagaagccaaagcagcatcaggagctacagcagccccaacgttagcccaaccaagagcgatcatttgaagtgaaccacctaagataaggcaaggtactaagttaccagttactaagccgattaaagtacatgcgattactggttgatggaaatggaattgatccaagataccttccacaccagctaaaaacgctacgataacgactaaaatcatttgaattgcattcaatgccatgattattaatcctccgttataattaaattatttttttgcgttaagctcatcttgagctttcttcataattgcatccatattgtcttttgaatcagttggaactttacgaacatcaagttcaacgttcatgtcttccaacttcttgtaagtatcaatatcattttggtcaaaagccaataccttattaggttgaactttaccaggtgaatgtgccattgaaccaacgtttaatgacttaagtggaacgccaccttcgattgctctcaaagcatcttgtggtgtttcaaataatagcatggcacgggttccaccaaaatgttgatcatccttagcaagtttaatcatttgatcaataggaacgatatgagccttaactcctgatggagcagcttgcttgatcattgaagaacgaagttcatctttagcaacgttatcagaaacaacgatgattcgatctggtttagtcgtctttgtccaagctgtagcaacttgtccatgaagtaaacgagtatcgatacgagctaagacataatcgaagtgtcctggacgaccagaagcaacttgtgcgctttctgctgcctttggagcttcttctggttgaagagcttcaggacgaaccttaaccccttctttagcagtttcaatgatatgagcagcaatttcttgtgctgattccattgataaacgtgaagcataagcttcgattagcattggcaagttcaaaccggcaacgattgcccatttgtccttgtgttcttcaaacaagttattaacttgattaaatggagtgcctccccataggtcgactaagaataatacttcgtcttggttactaaaagaagcaactgcttcttgaagttttgctctgatatcgtcagggccttcacttggcattaatgtaacagctttaacgtcttcttgttcaccgaagatcattgaacctgattgcaaaatacctttagcaaattcgccgtgactagcaatgataattccaaccatctgtctgtatacctcccatattatattgttacagcttaatcaaaaaataaataaaataagttctaaaacctgtaacttaaatctaaattgaacgtttattcgtttggaaaccaacttaaattaaaattttcaaaaaacgctttcaattatctaggataaaagatgggactgattaatcccatcgtgtttttcaaagtttaagttttaatttaaaatggcttctcatcagataaacatccatccatcaaagtggttaaacccgcttcgatgtgcgaaacacattgataattcaacatattttgcattcacctatatataagcaaataccgtgccaaaatacactaatgattaaataccgtagaatcagcattcttattaatacacatcgatactaatacactaattgtgtattaaaaagtgtgtcaatattgaaacagttcctagaaacacaaaaaggactcctatttctaggagtccttttttattgatgcggccaagagggttcgaacctccacccgagtaaattcggacaggatccttaatcctgcgcgtctgccagttccgccatggccgcaaaagcttactagataatagtatcaaatctacctactgctagcaagacttttttacgttttattttaaaaaatctaatttataataatttgagtcgtccgcgacacttgctacacacatacttgcgtgtattaatccgcctttgtcgggggtattgtaatccacaaccttggcattgatatagtaacttgggaggagttcgccgccgcttagaggtggttggagcataccttaaccctcccaccgctcgtaacaactgctgaaaatgtgggtttcgatgatctggtttctcgtttaacatatgcacaaaataatgcactagttcatgtttaataaccccgatcaagatcgcttcatcgaattcttccagcatcaacggattaatatcaatatgatgatcatttagatgatagcgaccaccagtggtttttaaacgtcgattaaagaccaccttatacggaaaacttttaccaaaggactcttgagcaatgcgttgagttaattgttgcaattctaagtctgtcattttaatccttaggaatcattgttaattgaattcggtggcgttcaacgtctacactttcaacccaaactttaacaatatccccgactgcaaccacatcgctgggttgcttcacaaaacctttctttagttttgagatgtggactaaaccgtcctgtttaaccccaatatctacaaatgctccgaaatcaattacatttcgtactgtcccttgaagttccatccctggtttaaggtcctctagcgttagaacatctgatcgaagtaatggtgccggcatttcatctcgcaaatcacgtcccggtttctgtaattcggcaataatatcagctaaagtttcccagccaacgttaagctgttcagcgactgctttaacctgcactccttgtagtttttcgttaacttccgctttaccaatgtcttgcaattttagtcccaataactgcattaattgtttaacaactgcataactttcaggatggattccggtattatccaaaatatcatctccatcaacaattctcaaaaaaccaattgcttgttcataggctttaggtcctaagcgagggactttttttaattgtttgcgagaatgatagcttccattttcctctcgaaaattaacaatatttttagcggttgttttagttaaccccgaaatatgggttagcaactctgggctagcagtatttaaattaactccaacttggttaacggccgtttcaacgacgttatcaagttgttcatgtaaatctttttgcgcaacatcatgttgatattgaccgactccaactgcttgaggatcgatcttaatcaattctgctaaaggatcttgtaagcgtcgtccaatactaatcgcacttctttcttcaacttgaagatctggaaatgcctctcgggcttcgttactagcagaataaactgacgctcctgcttcattgacaattacataatagatgggacgcttaatttctttaattaaattagctacaaattcttctgattcgcgacttgctgttccgtttccaattgcaatcatttcaacttggtacttctcaatgaaatcttttaattgttttccggctttagctcgtttttccattgaagctggtttatgtggataaatcactaatttatctaaaaatttaccgttctcatcaataaccgccaacttacaaccggtccgataagctgggtcaaaacctaagactacttttccctttagaggggcttgcatcaagagatggtataagttttcaccaaacaccttaatagcctgttggtcgcccatagcagtcagttctgcacgtaattcacgttcaattgctgggccaataaaacgtttataagcatcttgatatgcatcttcgactataccaactgcttcgccggtctttttaccaatcaaacgaaagtgaaggtatcgttcgattccttgaggatcaacctcaattttagctcgtaggaccttttctttttcgcctcggttaatcgctaaaatttggtgggaggccacttgattcagtttttcactgaagtcatagtaaatcccataaacaccgttctcatcaattgcttggcccttgggctttacttctgccgttaatcgtccattttttttggtataacttcgcacccattcacggatatcagcttggtccgagaaggcttcggctaatatttcgtgaactcctgctaaaacatcgtcaacactattaagattctgttctggattaatcgcactttgaagttgcttagctaaagttccttgtggaaaacccaaaatccaggttgcaatcggttctaaacctgcttccttagcaattgtcgctttcgtccgccgtttttgtttgtatggtaaatacaagtcctccaccgtttgtaaggcatcggctgtacgaatcttttgcgccaattctggagttaatttttgttgatcttcaatattttttaaaacatcggcttttcttttttcaagtgtttcagtctggtggtacgttgcttgaatttcccgaatttgaacttcatctaaactttgagttcgttcttttcgataccgagcgataaagggaactgtatttccatcctctagcatttctagtgtagctttaatttgatttgctcgataatcttttaacttagttccgacaatttttaaaattttttcttccaaaatcattttctccctttatcttaaaatctaacaagaagaggctgaggaaccaacttctccctcaacctctcgtattgcaatattaaacattatgcaagtagcatattcataattctagttaacgtcttggtaatttggcccataatttctgcttgagccttttcagaagcattaaaatcttcagcattaacttttttagcttctggattaatcgtatccaccattttttgacattcttcaatatatcgaagataatcatgtttcaaattttggtgtttcccgataaatttgataggagcttgcatttctgtaagttctttttcaattgaacggtagttatctgtagccagctgaaattgattcttaatttctgctaatttagcttgatctagatcagcaacttgtcccaactgcatccatttttttagttcttgaaagtatggatcgacctgttctcctgtttgttcaagtatttcagttaatttggaaattgtaccagcataagtttgaatattagctctcatttaatctctccactatttttttaaagtacgttgtattaattttaccacttcgacaatcacaatcatcgataatgatgcaaaaattacaatcatccattggtggagatttaggttgctaacatggaataaatcatttaatcctggcaccacaattgttgcggctaatagcacaaacgaaattacaattgaccaattgaagaacttattttttagcgttgttgcactaaaaatagaaccatgaactgattttgagttaaacgcatgaaatagttggattaagcctaatgttgcaaaggccattgttaacgcatctgcgtgaatttgagtagccgtagcatgatctggaaaacggagtgccatcgcataaacaaataaagtaatagccccttctaaaattccttggtaaattacattactagccacgcctcctgataggaagcttgcatttttaccacgcggtttttgtttcattgcgtctttttcagctggttcaagtcctaacgcaatagcagggaacgtatcagtgactagattaatccacaaaatatgaaccggcgctaaaatttgccatcccatcatggtcattacgaataaagttaatacttcacctaaattagccgacaaaagatactgaattgccttttggatattagcaaaaacttttcgtccttcctctacagcaactacgatggtggcaaagttatcatctgcaaggaccatatcactggcccctttggaaacttcagtaccagtgattcccattgccactccaatatctgcctgtttcagggaaggggcatcattaactccatcaccagtcatggcgacaatcttttcctttttttgccaagcatttacaattctaactttatgttctggtgccacccgtgcgtatacagcatatttatctacatttcgagccaattcttcatccgtttgttgatcaagttcggctcccgtgattacggctgtatcaacttcatcttcatcaatcattcctaaacgtttggcaatcgctcccgctgtatcacgatgatcaccagtaatcattaaggtccggattcctgcttgttgggcttctttgacagcttgtgcaacttcggtccgttctggatcaatcattccaattaaaccagcaaaaattaaatctttttccacagtttcactatctaaggctgtaggaatttcgtctaaaatctggtaagcaaatcctaatactcgaatagcttgtgtagctagttcatgatttgtcgcccgaattagtttgatttcagcatcattcattgggagaatttggttcttttccacatattgagtagttcgtttcaacaactcatctggagcacccttcactgttaaaagatatcttccatcttccaaagcattaatagtagacatcaattttctttcggagtcaaatggaacctcagccacccgtggataacttttaataacttcgtccgcttgataatttttggaatcattgaatgcaatcaaggcggtttccgtaggatcaccgatcaatcctccctcaatttttttagtatcattatttaaaatcattaaatcgtatagcttttgtttagtatctggaataacctcttcggcattcaggagttggttatccacaaatactttttccacagtcattttattttgggtcaatgtccctgtcttatctgaagcaataatttcagtacttcccaaagtttcgactgctggtaattttcgaataatagcatgtcttttagccatccgctgcgttcccagtgctagagtaatcgtaacaatagctggtaatccttctggaatagccgctacagctaaagaaattgctgttaataacatgtcaattaaggtttcttgtccacgtaacatccctactatgaatactaccaccgcaatacctaaaattagccaagttaaagttttactcaacttaatcaggttccgttgcaacggggtaatagtttcttcggcattattaattaagtcggcaattcgcccaacttcagtttgcattcccgttccagtaaccacacctagtccacggccaaacgttacattactattcataaatgccatgtttttacgatcacctagtgccggattttctccctcaatgggagcaactgctttatttactggtacagattcacccgttagtgcagcttcctccatcttaattgaagcagattcaattaatcttaaatctgctggaacgatatcaccagcttcgagcagaacgatatcgcccgggactaaatcctcactttttatcgtttgtactcttccatctcggcgaacatgcgcttgaggagcagctaaactttttagcgcgtcaatcgcctcctcagccttggcttcttggaatactccaaaaaccgcattcaaaataactactagcatgatgatcattgcatccactccttcgccaacaaagacggagatcagggctgcaatcatcaatacgataatcatcaaatctttaaactgttcaataaacttctgtaaaagagtggttttctttttggttgctaaaacattttttccgtattgttcagttcttttttgaacctcactagcagataaaccacgctctttattactttgttcctgcttcaaaatctcttctaccgttaactgccattgctctttgtgcataattccttttcctcctagctattttttaatgctgggtatgaaaaaagacccatgtgcgcaaggaatcttttcccacacacatgagtctcactaaattaagataataccagatttattcttgttggtgatattatcgcagatagtctgcaagttactccctcatgtctacaatttgattataaccgaccattcaaactaattacaagctaaaccccttctcttaataattagttatcgaaaaccgtataaggtaaaactcgtttatgagccgtccgtttataccaaccttcaattttgtcagccgcttcagaactaatttcgcgaccttccagatagttgtcaatatcgtcgtaagtaacccctaaggccacttcgtcaggcaacgctggacgctcctcttctaaatcagccgttggggtcttttcataaagttcaaccggtgcgttgagctcttttagcattgcctttccttgtcgcttatccaagcgccaaagagggataatatcagctccgccatcaccaaatttagtataaaatcccgtaacagattctgcagcatgatcggttccaattacaattccagcattacttcccgcaataccatattgagcaatcatccgttcacgagctttgatattccctttgttaaaatcagaaatttttaaatcattagcttccaacgcagcaaccatggcatctgccgctggtttgatatcaattcgaactacttcatcggcttgcataaattcgattgctttcattgcatcggattcatccgcttgcacaccatagggcaagcgaactgcaatgaaccggtagtcttgaatacccgtttcttcccgtaattcacgaaccgcaatttcagctaacgcaccggcaagggttgaatcctgtccacctgagattccgagcactaaggaacgtaaactaggaactttttttagataatttttcataaaatctacactacgacgaatttcctgttttgggtcaatcgtcggttgaacctttaaagtttcaataatctctttttgtaattctcgcaattttatcacctagtttgttaaaattttagtttcccaacatattcacggactcgcttgataatagcaactttattgtcgtagcaatcttgtgaaagatccaccggataatcttgtggatttaaatcccgtttgtactcatcccacagagaatccaaactacgacgagcaaattctttaatctcagccaaacttggtcgatcataaactaatttaccatcttcaaaaatggtttgtaaaactggacgagctttaaaatcagtgaccgttttattaatatacgtgtagttcggatggaacatgtatagagactcttctactcgaggatcttcatcccaaagagtgatgtagtcaccttccgattttccatctgagtttcttgaaatacgccaaacttgttttttacctggagtagaaactttctcagcattatttgataatttgatggtatccaccattttaccgtcacgttcaattgacaccatcttataaactgcacctagcgctggttgatcatatgccgtaatcaacttagtaccaacgccccaaacttcaatcttagctccctgcatcttcaagttttggattgttttttcatctaaatcattcgatgcaaaaattttagcattagggaaacctgcttcatctaattgttcacgaacacgtttcgataaataggccatgtcaccactgtcaattcgaactcctaagaaattaatcttatcgcccatttcttttgctacgcgaatagcattaggtaccccactttttaatgtatcaaatgtatctactagaaaaacacaatcacggtgagttgtcgcatacgctttgaaagcatcataatcattcatgtaatattgaaccaatgcatgcgcgtgtgtcccacttactggaattccaaatttcttaccggcccgtacattactggtagcatcgaagccaccaatgtaagcagcgcgagttccccaaagggcagcatccatttcttgcgcacgccgagtaccaaattcaagtaacttgtctgaaccaactaccgacttaatgcgagccgcttttgtagcaattaaggtttggtaattgacaatattcaataacgctgtttcaattaattgacagtcggcaagtggcccttcgacttgtaaaataggttcgttgttgaaaactaggtcgccttcaactgcagaacgaattgtacctctaaaatgaaaatctttaaggtaagctaaaaaatcgtctggataaccagccacatcctttaaatattcaatatcgctctctgaaaaatgtaagttactgatataatcaataatgcggtctaatccagcaaaaacagcatacccattatcaaatggcatatttctgaaaaacacttcaaagatcgccgtcttgttgtgaattcctttattccaataggtttggatcatattgatttgatacgcatctgtatgcaaagttaatgtgtcatctggaaactcttttaccatgatgattatgctcctactcttttatgtttttatttaatctaacaatacagttgttttaattttatcatttatacattaaatcgcaatttttaatctaggagacccttatgaaatataattttgttaatattctcggatttaattttctgaatgtcactaaatcacagtttttaaaacaagttgaagaagatcttcttcaacatcaaaatcgttttatcatcactgctaatccggaaatcatcatgtttgctcgcaaaaatcctaattacgcaaaaattgtgcgttctgctgattatttagttcctgatgggattggaatcgttaaagcatccaaattcacgaaaacgccgttgacagagcgagtaactggatatgatgtctttactgaactcatgcagtgggccaatgaacatcattccaaagcctacttcttaggtgggaaacctgccgtaattaaaaaagttgttcataaagttcatcatgaacatcctggtattaatttggttggttatcacgacggctatttcaaagattcccttccgattattgacgaaattaaagaacttcaacctgaaatagtttttgtagctacaggttttccaaaacaagaggaatttattgctaaatatcgtcattttaccccagcaatctggatgggaatcggtggtagctttgacgtctacgccggaactgttaaacgggctcctgaattttggcaaaaacataacgttgagtggttatatcgtttattaagtgaccctaaacgaatcaaacgccaaatagtattaccgatttttatgatggaagcctttaaagcaaataaaaagaaggaaaaataggattagcctattcttccttcttttttattaacgatttaaataaaattcaaaacgttcgcctacatactgagtacgtacatattcaaacggtgtaccatcttgagcatacgataattgatgtaaacgtagaattgcatcgccacgtttaatatctaaatactctgacactttttcagaagccaacatcgccgagacggtttgttccgcacgtccaatcatcaaccctgctttttcttccagagttttataaagtgatttagtcacttcagatttactaaaatcactaactagcttttctggaatagttgccgtttcataacaaattggaacagcgtcagcaaatcgaatacgctccatccgcaatactagatcgccatcatttaactgtaatttttcaatttcacttaaagaaggttcactagtatggtacgaaattgtccgactagacggctttttaccttgagcctccgttaattccgtaaaactagtaactcctgaaaccttttcttgaactttctgactagcaacataggttcccgaacccaccttacgttccaaaattccctcatcaaccaaagttgaaatagcttggcgaagagtcattcgacttacactaaattctgtagaaagttcacgttcagctggaattcgctctcccactttccatttcccggcttcaatcgcctttttgatttcattatgaatttgaatatataccggtgaattcattcttgtacccctataatgtttgactattagtcttctttagaaaactttttcccgtaactatatgtttccaatttgttaaggttgctatcaaagacgttgatatctgcatccttaccaacttcaagtgttccctttgaatccaaaccaaattcgcgagcttggttaactgagctcatttgtacagcttcagcaattccgcaattaaagaaacgcattgcatttctaaatgcatcatcaaatgcaagtacagaaccagctaatgtaccatcttccaaacgtgcttgtttgtctttaacgtaaactttttgtccaccaagttcactttcaccttcagcgaatcctttagcccgcattgaatctgtaactaggtcaattcgttctggtcccttaacttcgtatgctaatttaagcatatcaggaacgatatggaagccgtcacaaattaattcagcgtaaatgttgtcttctaacataacgtgtccagttacacctggttcgcgatgcttaaactcacgttgagcattgtaaagatgagttgcatgagtaacagtactatttagtagttccgcacgagttgcgtctgaatgacccactgaaggcacaattccatggtctaaacagtaagcttcaaaagcatcagatcccttatgttcaggtgcaattgtaatcaacttaacacgaccaccagataattcattccatttacccaaaagttctgcatctggatccttgatgtactcttcaggttgagcacccttatacttagtagaaataaatggtccttccaaatgaaccccttggataactgggttatcttcagcagctttcgcaaccccacgcattgctttttcaatgttggcatttgattgggtcattgttgtacaaaagaagctggtaaccccttcgttaacaacggctttatttaccatttcattgatttgatctggatcaccatccatggcatcaaatccgtatccaccgtgtgtatgtacatcaatgaatcctggaacaataatcttttctccagcatagaaaacttgatcatcaccttgggctttgtattcgctcattggaccaacggcttcaatttttttaccaaatcgaatgtaaccatcttcaattttttctaaaccagtataaatagtagcatgacgcaaaactgtactcatgaattttcctcctaaatttttaatctaaatccattatatatcggtatagaccaaaaaacaagattctaatgattgatttcttttgctaccgtagcatcgattcccttaacaaccgctggtgaaaagcctgcttcttccattgctaggagtcccgccactgttgtaccacctggagaagatactttatcaattaaggcatacggtatctcatcggatttcagaaccatttctgcgctacctttgaccatttgagcagcgatctttgtagcagaagccttagttaatccatgtttaactcccgcccgtgaaagagcatcaataaacaagtaagcataggcaggtgcactaccagcaattgctgaaaaaattggaaagtctttttcagcaagttccattgtacttccaacagtttcaaagattttaacgccggactgaaatggttccattttaagatcaccattagcaacgaccgctgtcattccttcgccaatttcaacgttaacattcggcataatgcgtaagataggttgttgctcatctaagctggtctgtagatcttctatactaattcctgatgccagtgagacaactaactgatgatgatttaaatcatctctgacttcgtctataaccgtttttactacgtatggtttaaccgctatgacaatgatatccgaatttctaacaagttcttggttagattttgtcgctattagttgattcttttctgcgaaaggtccataacttgattgatgcgcactgtgtaccagtatatctgtgctttcaaaattattttttaataatcccttgataatcgctttggccatattacctacaccaataaatccaattttcataaaaaaagccccccattggttatttcattttgttctccttatcctatcattaactaggccaatattgaaagcctccaattaaaaatttaagctatcaacctccaactaattactaataccattctaaaaacgaaacatattaaaactatctgtgatttattgatttagatacaaaaaaacatcatatcaatgatatgatgtttctgaaaactagattgggctagctgggatcgaaccagcgcatgacaggatcaaaacctgttgccttaccgcttggctatagcccaatatggtggaagggagtggattcgaaccaccgaacccgaaggagcggatttacagtccgccgcgtttagccagacttcgctacccttccatataagttgtcgtcttatctatccgacttaataataatacccaatctcgaataattttgcaagcttttttttaaacttttttcaaaattatttgagatcggttataagcaatcgctgagtccattcagtgaagaaatcatctgaattccactcgttgattcggttgttatgataaccgactgaattattataatatattccattagactttgcaagtggtttaaaatgatgatgtaaatgtcctgatatcaccaattcaggctggtatgtttccaacaacttttccattcttctgctccccgccattccattaatcatgttccaaaagcgggcatcttcggaataatgaatatactcatgtcttactgcaaagtgagtcataaataacacttttctccgactggcctgctgcatttgttgttcagtttgcttcaacacaatattcattcgttcaatatctgacataggctgttcaattccagtatcaatccagaaagactttttccaacgccaaaactgttcggtggttttatcaacattatctgcaaacgtatagtcgtaccacccattatttccaataatacgccatttagtcccaggaacgtcatagaactggttatgcaagtataatgggcttaaatttgattctaattgattatagtcgatatcgttcaacatatcatgatttccggctatgaaaaaaactttagtgtgttctcccactaattcctgtagcttttccacgtactgcatgcttcgattaaatttattaaataggtctcctgctattaaatatactcccacatgttgttttaaaagatactcggcttgtttttgagccatttgattttcatctattttgttcacatcgaaatgattgtcgctagttgctgcaattttcaaactattaacctctctgataaatcgaatatactaattcgtttttttgatatacatctataagacggaccggaacttgctcctctaatcgatcaaaaagtcgaatacctgatcctaaaaaaatcgggaccgttgttaaaatatatatatcaattaaattggcttgcacgagcggatcaataagcttagctcctcccacaatccaaacgtcttttcccttctccttttggattcttttaactaattctactggcgactgtttccagtatttaatcgtatctgtatcttcccctaggtgagacgtaacaatatacgtctgccgatctgcgtaaacatatttttccggagataatttttgtgttacttgttcataggtagttcttcccataataaccgtatctattttggaatacattttctcataactgtcatcactttcggtaccatggacatttttctccaaccaatcaacggcaccttgatcgtcagcaatgtaattatcaatactcattgcaataaaaagtattacttttctagccataaatccctccaaaataaaaagatgaactaagcataacctagttcatctcttgaattcaaatatttaattatctaatcccttgcatcttcttagtaatccatggtgaacaaattaatagtacaagtgcaaagactagtgttacaagacctaatacaataaagtaagctacttcatgtcctgggtagaagcgaactaactgagcgttaattgcttgtccagcagcatcggctaagaaccacatactcatcatttgagacgcaaatgcagcaggtgccaatttggtcgttacagataaaccaattggtgagattaacatttcaccaatttcaacaattgcccagctaccaactaaccaaagagcattaaccttaccatcagtaccaaacatcaaaccaggtaaggcaataaataagtatgatagacccgtaaatacaagtccatacgtaaatttcttaggtgatgaaggttgcttcttacctaacttagtccatagccatgcaaaaattggtgtataaagcatgatgaataatggattaagggactggaagttagcgggcgtaatatgcatccaaccgtagtttaattgagtacgatcagcagcaaataatgctaaaacaactgaaccttgttcttcaattgcccagaataacgttgcagcgataaataatggcacataagcccataaacgtgaacgttctgttttagaaaccttactacttgaaaacatgatgataaagtaaacaattggagcaataacagcaataatactaattaatagaacaacattatcaattgttaatgcattagcaacaaacataaccactaaaattaatgctaatacaatcacacccattaaaactcgaagactaaatttcttaacttcatcgggttgaattggatctgatggatataaactatctttatttaaatattttttaccatcaatataatattggactaatccaaagaacataccaattgcagctaatgagaatccagcatggaaactcatattaaaaccaacccacgaaacaattatgggagctaataaagcacctagattaataccgaaaacaaaaatactaaatccggcatcacgtctcgtatcctccacggaatatagtgatccaaccatttcagaaacatttggttttagcataccagtaccagcaacaattaaagcaattgatactagtagggccgccccaccgaaaggaagtgaaagtgcaatatgaccaaacatgatcaatacaccaccgtaaaatacggtttttcgactacctaaaattcggtcactgataaacccacccgcaacactagctagataaaccagtgaaccataaatggccattactgaagcagcagtggcttgactaaagcctaaaccacccttggttacagcgtaatacatgtaataaattaaaattgcacgcataccgtagtaactgaaacgttcccacatttccgtgaagaacaacgtcattaatccacgtggttgaccaagaaatgctgtatccttatcttgtgtattcaattgtatatttcctccataattttcgccttaaaaacaaagactgtatatgaaaaaatgcgccttaacttaacattaaggcgcatccaaacaaatgccggctaggtgagtcgaacacctgacctacggtttacgataccgccgctctaccaactgagctaagccggcatataacaaaaggatgctaactttccagttaacatccatacagccttcatttatttggagagttgtccgagatggccgaaggagcatcattggaaatgatgtaaacgggttaaagcctgtttcaagggttcgaatcccttactctccgtatatatgataaaagtatgacccgttggtcaagtggttaagacactgccctttcacggcagtaacatgggttcgaatcccgtacgggtcattattttggaggattagctcagttgggagagcatctgccttacaagcaggaggtcacaggttcgagccctgtatcctccattccaaaattttttctttggtcctatggtctagctggttaggacgcctgcctgtcacgcaggagatcacgagttcgagtctcgttaggaccgttgttacatttatatattttttggctcggtagctcagtcggtagagcaatggattgaagctccatgtgtcggcagttcgattctgtcccgcgccatagtgaacgtttagttcacatttagttttgtttttaccaatgatagggatatagtttaatggtagaactacggtctccaaaaccgtcagtgtgggttcaactcctactatccctgccatgatggcggtattggcgaagtggttaacgcaccggattgtggctccggcacgcgtgggttcgattcccacataccgccctttaggttgatttaaagacctactttataatatagcaacgctagatgccgctgtggcggaattggcagacgcgctggactcaaaatccagttccttcacgggagtgtgggttcgacccccaccggcggcataaatttagtaagattgttatcgagctatttcgtgtaattttcgtgtaatttttatgcgagtaattacacttttttattataatggcggtatagccaagtggtaaggcagaggtctgcaaaaccttcatcaccggttcaaatccggttaccgcctttaataataatgggttagttttaactaactctttttttgtactttaatttaactgtgttagaaatgcagtagagcctttcttgaaagaaaagcacctattaacgttcagtactccctaaaagttagatcaaatatctgactaattgggaagcactgttgcattaataggtgcttttttacttatgaaagtttattttttagaatttcttttttgttctattaataatttgatactaaaaaacatgtctgtaaagtcataagcagcaaagacaattaaaatagtacgtaagaatgtagaaacgtcagctgagacctttagataataaacaaagaaaatcccaacaataaagtcaaaaataatatttgaaattaaagccttattgttcttctttaagaaaatttgaaccattcctttctatatacgttataacagtatacagtataataactataatttcatagtattacaacagtactttataagtagttctaaaatagttgtggttcacgtaaggctccaaagtttttttaagatcgtgtgtatctaaagtgacttgatcggacttattcgtactccagatggttagaacagcacgattatgtggttttccatctagaggagatagtaagagtacactttgcaaaaaactagagtcagcattaatgccactccaatgacgcaccttttcatcaaaagctgagagagaatcacctgctaaatcaaaaaaatcataaataaaaatatcacccatatttaagaatggactttcaaaaagaactctataacgattaggtgagtaaaaaacatttttctggtcggaaaaatcaactaattgaaagctagtttctttagcagagtttgataataaagtcatcttacgagaagcatatttttctttgatttctcttaaaacgggttcactaccgaaagatacatttaaatttttcattacataagcacctccatccatgttctattatagttgttttaaaacgaatcgaaaaccattataactttgcgttaaaatagatacataaagtaattgggaggaattaaatatgaaaataacagttttaggatattatggtggatatcctagcgaaaatgtgggaacgacagggtacttagtgcaaagtgacaattataatttattgttagatgccggttcaggaactttattggaattacaaaggcatttgaatccacttgatttagatgcagtacttttaacacattatcatcacgatcataccgctgacttaggggtattacagtatcaatggcaactaaattctaagaataaggttgaaattttgccaatatatgggcatacagaagacccactaaattttggagctttaacttggccaaacgcttctcaaggcgtaggttataatgagaatgaagaaattgatttaggtccttttacagttagtttcaaaaagacgattcacccagttccagcgtttgcaacgcgaattgtagaacgagaaactggaaaaattttcacatttacgtctgatacaagatattttgacgaattagttaaatttgcaactaatagtgatttattagtaacagataccaattttttgagtaatcatactgggataaaatggcatctaagtacaaaagagacagcagagttatttaataagtctaatgcaaagcaattaatgatcagccacttatctccccagattgatattgacgaaatgttaaaagaaacaaaacaattttcaaaaaataaaaacaacatttttgcgcctaaagttgggcttaccatcgaaatttagaaaacagtttcataacttatgatttttgtgttctataagtttttattaaattctctttttaaaattatttaacataattatttaatgtgtaaatttagtgtgaaataaacggtcttattctaaaaaccatgcctttgttatatttattttttgtaagaaaaaaggttaacggaggggtggacaaaagctaaataacattgtacaattttaattacaggttaagtaatgttacaggtcaccaaagggggaatttaatatggttattttatacacatcaccaagttgtacttcgtgtcgaaaagcaaaagcgtggttgaaagaacacagaattgattttacagaaagaaatatcttttctgaacccttaagtgccgaagaaattaaaagagttcttcggatgactgagaatggtacggaagaaattatttctcgccgctctaaagttttccaagagttagatgttgatttggacgatttaccactccaacaacttattaatttaattgaagaaaatcctggattgcttcgacgtccaattatcatggatgacaaacgacttcaagttggttataacgaagatgaaattcgtcgtttcttaccacgaaaagtacgtcaactggaattggcaaaagcacaaagtatcgcaaacctttaaaatagaaaaagaatcactttgggtttacaaggctccacagtaactcgaaatgattctttttattttgggtgacctgaaacggacaggtggtattgtcttatattttgtgggataattataggaaacaaatatactgttatttccattcagtttcgatagaactggaggtgctgattaatggaaatggaacgaattaatgatgatacaatccgagtaacaattagttcggatgatttaaatgagcgaggtgtgacgttcctagatttacttgataatcataaagaaatcgagagcttcttttattcggtattagaagaggtagatacagatcatcagtttgctagtaatgatgctgttactttccaagtgctacctaaccgtaatgggttagaactatacattagtaagaacccaactgatggcatggaagaagctataaaatcagtatcaaaagacaatgctcgtagtaatggggagatggatgaagtgtcggactttttaaagagaaaattggccgaaacagattcaaatgataaaaataacgatgattcaagctatacgagtgacggaaatccagctgatctaaatggctatgctaatggagttggaagtacgcaaaaatcagtgatagagttagaggattttgaaagcttaccaagtattgcagaattgataaaaaccaatagtggaattgagtcagttctgtaccgttatcatgacatatattatttagaattaactttctttaccagtgaaaattcccctgaaactattaagaatgacttagcaatcgcgtatgaatatgggaattcgactattgtttcaagcgaggttcttagagaacacggtgaagtagttatggatggagcagctttagagctggctaagcgttattttaaataatcaaaaatagattttaccaaaacacaacattaatttgttgtgtttttttcgtgggaaagatcccaaaagccgtatttctatattggggtgaacctaatgaaaattggaataactaaaaacggaactttagtggaagcaagaaaggctgatcggaatgaaaagtacttttgtccaagttgccaacgagcgttaaaactatgtagcgggcaatacaaaaagaactattttgcccatcaatcctttactaagaaataaggctatcagccaaaaggtgaaactaaacgtcatttaatgggtaaaaaaaaggtcatcgatttcttcaatcagcgtcaaatttctgtacagacggaattttatctaccagaaattaagcaaagagcggatttgagagttgaaatcgatgaccacatatacttagttgaatatcaatgtagtccaattaagttaaaggaaattcaaaaaaggactaaagcgtatttgaaattagggttgatctcttattggattgcgggccctaaacatcttggaaaaggaagtctttttcaaaccgtacagaaatttggccgtttttctaaaaaagaaggatggtggatcttagcttgggatgctcttaaacaagaagctccccatgtattttttaatatgcaacgagcagttttaggcaaagttctttatcaagaaagaatttttaattgcaaaggtcatcaaaatgaatttataagacccaaattacctaccgttgaatatgaggcttacaagattgaacattccttactaggaaatcaaattgaccaacgatatgtagaaatacaacaattgtgctatacaaatggtaaaaatttaatgggatgtccttggacggttcattttccacgactgtgcactgattttaggaatcgtgggattccactactaaatcgagtgcgctttttggttttagcagaacaaaaagttaaagtatctatcactgatattactcaaattgatattgaattttggcaaatgcttttagagaaaaacatcgttatcagtaatgatggcgaatggtattttatttctcaaaaagtgcaatggtataattcattatcagaaaaattggcaaaaaaaaatcaaagtaggataagtaagctttgattttaggagactatagggttttaggggtaaacaacttcttgggctgagtcttttgaatcatttttaattgacacaccgatgcaagagtttggtagtcatagtgatccattaagactccacattcttcatctttgagattaaagataaccgctgctgggatgtcttcggcgcccatttcatgagcaagtttttgatcccgtttaaagtcttcttgcgtcatttttgattggcgatcttcttcaaacatggctgtatctaaaccagcttgtctagcaatagtgctacctaattcaaatgaatatgggacattgttgtcaatgattgcattttgcattgccattaagaaagcacgccccttggcttttccttgataactagcggctttataatcaaggctagttagatacattcggttaaaaagttcgttataattagcgtctttaagttgattgcgtttaatgaatttaaggacaacgttcatatttaaaactgtaataattttaaaatcaactttctcctcagcatatttaaaatatcgaatagtttctttttcgcagttaaagcactcatcgccccagggagtgatgaaaagataagtttcaagcattttaattcctccaaagaattacataagtcaaactgtcttttactttaccaaatttaaatataaaatcaattattttgttttaaaaaatctgaaaacaatgtttaaaaagaagttttagtttctatgatagaatagaagaggttgttaatttggttcggagggatacgcatgattaaagattgggatacctttttattaccatattcccaggctgtttctgaattaaaggttaagcttaggggtatgagaactcagtttctaaaaaatggagaagaaagtccaattgagtttgtgactggacgagtaaaaccagttgaaagtataaaagaaaagatggttcgtcgccaagtcctagaagaacgcatagaacaagacatgcaggatatagctggcgtccgtgttatgtgtcaattcgtagaagatatctatgaagttgtcgatttaattcggaagcgtactgatatgacggtaattgaagagcgagactatgtcgaaaatgaaaaacctagtggttaccgttcttatcatattgtggtggaatatccggttcaaatgatgaatggtcaaaagaaaattttagcagaaattcaagtacgtacacttgaaatgaatttttgggctacaatcgagcactctttaaattataaatttgacggagaatttccaaaagaactaagaacacgtttgcagaaggcctcggttaaatcatatgaattagacaaagaaatgtctgaaatcagaaaacaaattttattagcacaaaaagaacaaaaggatgtctaaatatgagagtagctatttatcattcaagtgatgagcattccattcaagttggtaaagatttagcaaagattttatctcaaaatgagattgtaattgataacgaaaaacctacggtggtgattaccattgggggggatgggacgttactatctgccgttcaaaaatatcttaatcttcttgaagaggtccgatttgtaggtgtacatacgggacatctaggtttttacacagactggcgcgaatatgaattggaaaccttagttaaggctttgaagagtgatggaggagctgaagtttcgtatccattattaaatattgatgtgactcatacagatggttcacacattagttataaggcagttaacgagtccacattacgtaaattgtctgggacaatggtagcggatgtattgattggtgataatctatttgaacgtttccgtggggacggtctgtgtatttctacaccaacaggatcaacggcatacaatcgttcggtaggtggagcgattgtacatcctagattagaagtattacaaatggctgaaattgcgtcaattaataatcgcgtttttcgaacggtgggagcttctttaattatggcgcccaacgaaactattacaattaggccagtacctagtttccatcgaacctacaattttacagcagatcgtatcgatttactggataaacatgtcaaagaggttcactatagcattgatgaacaaaaagtgaaattcttaaagtatcgtcatactggattttggaatcgagttcgaaattccttcattggtagtatcgatgaagtttagatggatagttaactttgagagtcggcagcacctacggactttcttgggtaggaaaagaatttcaaggtcattattaaaaagtattaagtttaatggcggtaagatttttgtgaatggattacctacgagaacaaatgcaatggttgaaaaaggcgatttagttgaagtgactttgccacctgaacctagtaatccacatgtagggctatctgatgtaccaattgatgttcgatatgaagatgcagattatttgattgtaaataagccacccttcttaccaaccgtacaatctgcagctaatcaaaaggatacattagttaaccgggttaaaaactattatgttaaaaataattatgagagccgagttgtccatgtggtaactcggttagatcaggatacatcaggattagtaattttcgctaagcatcgatttgctcatacagtgatggatcaagatttacgtcaacgtaaaattaacaagatgtatttgacgattgtagagggaacatttactaaccaacatggcatcattgaaacaccgattcaacgtgacccagattcatttattaaaaggatggtagctccaatgggcgaaggaaagccgtctttgaccgaatattgggtggaggatacctttaaaaattttactttgctgaaagtaaaattacattctggtcgtactcaccaaattcgagttcattttagttcaattggacatccattagtcggagatgaattatacggtgggatggctaacgatatcttacaacgacaagccttacattgtttctctctaacttttaaaaatgtttttacggaaaaaatgatcgatatcaaaacgtctattccagatgatatgcttgaatattggaataaagagaaggacgaagagcatggataatactcaagctatttttgaaaaattaaaaatagaattattaaaacatcattccaaaaaatttaaagaagatttccttgatttacataattatgatcaaggtcgtttttttggtgaattaacgcgtgaagaacgtcttctcgtgtacaagtatctagacccggatgagctggcggatacatttgatgaacttgatgatgaaccagatttaattgcagaatatctggacgaaatggcacctagttatgctgcaacgttgttaaacggaatgtatgatgataacgaagcggatattttaggagctgttcgaaatgacaagttacataaacttctatcatatatgcaacccgtagatgctgcccgagttcgccaattacttaagtatgaagaaaaaactgctggtgcgttgatgacaactgaattcatttcagttgccgtagatacaacggtgggctcggctatgaatcaagttaaacaggaagctcaatatgcggaaactatttcatacatttatgtggttaacgaatctaatcaattaattggagtgatttcagttaaggatttaattgttaacccggatgatgtatttatcaaacgaattatgaatacgaacgtggtatctgtaagagatgatgaggatcaaactgaaattgctgcccaaattcgtgattataactttattgcaattccagttgttgatgaacgtaataaaatgttaggaattatcacggttgatgatattatcgacgttattgacgaagagtcggcacaggattattcacgtttagctggggttaattctgaagatatgtcagaaaatccttggaaagctgtcaaaagccgaattccttggttagtaactatgctgtttttaggattaattagtgcaatggttattagccaatttcaaaatgtactcgataaatttggcgtgttggcagtatttatcactttaattacaggtactgcagggaacgccggtacacaaagtttagctgtagcaatccgccgactagctaatgatgaagaaggcgatagtgtttttaaactaattttgaatgaagttattaccggtattttaattggtctattaacaggaattgctatttttgcggtgattttattctggcaaaaaaacatggttttaggaattatcgttggggcggcgatgagtggggcaatctttgttgctaaccttgtcggaactttaataccgattattatggaaaagttaggaatggatccggttgtagccagtggtccgttcatctcaactttaagtgatataacttcaattttgatttactttaatattgctacaatatgtttagcaaacttttactaaaacaaaaagacatggatcacgtaacagtgattgcatgtctttttgttttagattaattttgaaccatggagttcatgaacccctagctcattttgaatactttcagcattctgtgaggttatgccaccaccgggcattataataatgcgattagcagcatacttaagattagatttaatttgttctaaacctttttcaataggttgatctaaagaaccgccatgcgtaagaatacgatccactccatgttccactagccaatcaatactctcagtctgttttgcggtaggaattgcatcgaaagccatatggaaagtgatttgcattccacttgcagcaccgatcaattgttccattgcttcttcatctaagcttccatcagacgtaagagcaccgaagacaacgccgtcaacccctaactcttgggcttgaaaaagatctgcttccataatcttaagttcgatgtcattgtacacgaaattaccaccacgcgggcgaatcattgccatgacaggtatcccatgctcactagcatacttttgtgtttcggccattacacctttactaacggtggtaccaccaacggcgagattatcgcaaagttcaattcgattggcacctttagcaattaaagctggaatatcagtaaaattttctactggaatttctttaaacataattctctccgttctttttatttaaagtgaacacatacaacttcaggagctgcaacgtctttttgaatcaattccagtttaccatcattagaatttctttcaaataaagataaattattagtagtttggtttccgactactaaaaagttttgttcatgacttaaagcaaagtcacgaggaaaacttccttcaacactgatattttggatgagtttcaattgaccatcagcttggatttcaaaaacggcaatggaatcataaccgcgatttgaaacgtataagaagcgactatcatcagtaatgcgaattgccgcacaaccattatgttggttccaatcatccggaatggtcttaatagtttggagatgggttagctggcaatccttataattaagtactgctaccgagctggataattcaccaactaggtaggctgtatcaccagtattattgaaaactatatggcgtgggccaaatccaggagtggtttcgaaagtgctaataattttaaaaccagttgaatcataatctaaaacgaaaacttggtcagtccctaaatcacaagcaatcaatttaccgtcaggagtgaggtcaacgtaatgcaaatgtgaaccgtcttgctcttttagagggcctttacccgtattagtaaaagtactatctagggttagtgtgtgatcattattaatactataggcatgaagagtaccttcgtgatagtttgcatcaaagacgaattgatgtttttcatcaactgtgacataagccggaggagtaccaggagttacgatatgttgaagaacgttttggggtgaatataaatctgtaacagataagccaccttggttatcaaaacggtcaacagcatataaaatatttttcttgctaagtgctaaataagtggggttttcaacttcggtaactaactgtaaattagttaactgttttgaatcagtatctaaatcaatttgataaacacccttactagtttgttttgtatacgttcctaataaaatggattcaatcataaaatagtcctccttgctcttttaaacgttaacaacaagtataccacatttagttagtattgaatgcgcttactaaagggataatactatgcgatatgatacaatgaaataagaatatagaaagggtgtttgtcttgatgatttcagcaaaaattatgagtgtcggaccggatgcgatttcaaaaaaagatgctttagccattttattcgacgaaactgcaacaccggatttaaaaaacattgcgattattcaagcgattgatgatcaaaagcatcaaaaatttgctttgaaaaaaggtggcaaaattaagataggtaaaactgaatatcaaattaattttgttggtagtttagtgaataataacttacaaatgattgggcatacaacgctggaatttaaaccggtacctgaaaaaccgttggaaagtgcaatctatttaacacctaaccaatttccagaatttaaagttggagaagagattatatatatgtaggcggtgaacaacagtggacaataaaccaagaaataagtattggagaagctggtttaataagcttgtattagataataggccagtggtaagtttaatcatcattttattatttttgatgattttatacatgatttcaaaagtcacatggatttttagtccactaaaggaatttttcggaattgtgggttttcctattattttagcgggagtcttatattatctgattaatccactagttgataaattagaacagcgattcaaattgaaacgagttttatcaattacgatcatctttgtcttaatcacgattttaattattgcaggaattgtgtctgtcattccggttattcgggagcaatccgcggcattgattaaaaattggccggactactggaattcaggagttgagaaggtcgaaggattcttaaaagatccgcgcctaggagatttaaaaaaacaaattgatggtattggtagtaatactgttcaatcatggagtaagaaggcaaccgaatttgcggataacacggtcacatcgttaggtagtgtgattggtttgattaccaaaatagttattggcattattacaatgccgtttattcttttctatttattaaaggatggacatcggttacctcattttatcgcacaagtttttcctgttaaacgccgggatggattcattcaaattttaacagaaatcaatacacagttaagtcagtacatccgaggacaattgattgtggcattttttgtggcagtaattttctttattgggtattcaattattggtcttaaatttgccctaaccttaggagtagctgcaggttttctcaatttaattccatatttaggatcattcttagcgatggtaccttcaattgtaattggggcttttgtttcgcccatcatgctggtcaaggttttgatagtcttcgtaattgaacaaacaattgaaggccgttttgtttcaccgcttgttttaggtagtaatttggatattcatccggttactattttggttgtattgctagcctctggacagatttttggtttggttggcgtggtatttgggattccagcttacgcggttctaaaagttctattcattcatggatttagagcatttaagaaaaatatcggtggatatgactgaattaaagcggagtttgcggaaaccaaaaagtaatgttaatatgcagttgaaatcgtttgatcgcaatatcgactatgttcgtttgaaacgggcagattgacttcacgaacgtagatactcgccgcgtaataccgagtatctgcgtttttaattctaaaaaatatttggagaaaaattatgacaaatcacattgtattatttgaaccactaatgccggctaatactggtaatattgctcgtacttgtgcgggtacaaatacagttttgcacttaattaaacctttgggatttaccatcaatgataagacggtaaagcgtgcaggactggattattgggacaaagttgaaattgtatatcatgaaaatttacccgaatttttagcaacggttcctgataaaaaaagattatttgttgtttcaaaatttgctaaacgtgcatactcacaggcagattataccagcgaaaataatgatgaagataattatttattatttggaaaagaaactacagggctacccgaagcatttatgcggcaatatgaagaatgtgcaatacggattccacaaaatgatgaaaacattcgggcactaaatttgtcgaattcagcggcgattgtaatttatgaagtgttacgtcaacaaggattccctaatttagagatgagccatttgtatgaaaatgataaattaaaataggatttgatatggcaaaaacaagaaaaaaacgaaaaacaaagacaagacgtaaaactaagcaaaagacccaagtaccaacaaaaaatcttttaggtttaacttacgttttagttgcaatattagggtattttggtcgaggatttctaggaattttagtcgctaacatgtttagaatctttgttggtagtcttagcccaattttattcattattctattcatctatggattgtatcttttattcatgggaaaagaattgtcttttaatggaataacagatcgagtaattggacttagcttgactttgttaggatatttattgtgggtagagtatcaatttgccagtagcttaagattagaaaatgggtttatcagtcgggccattgatggcattgaacgatcctttctagaacaaacctctacaaatgatgttggaggaggaattggtggagcaactttatataccgcaactcattttttgcttagcagcgtagggagcatgctcttttcagttattctaatggggatggggctggtagttctgtttggtatcccatttgatcaagttttggaaaaaattggaattggatttgcttggaccatacgacatgcgatcgctagttttaaatctgctgcaaacaatgtatacgactggttcagcaatttagatttttcagaaaaagaacaatcaaaaaccagaaatgaatcaagtaaaacgggtgttactcgatcaatgcacagggcatctaaaccagtaattgaagttaccaaaacggatgaaaaagttttggaagaacctatcgttgatggaactagaggaaccgaacatccaattgaaccaaaaattgaaattgcgactactaataaaattcaacgtaaacctaagaatcaggttaacaatgatgatttagaaattaatagtggatttgatagtgagtctaagactaatcctaattatcgcttaccatcatcggaactattaactgaaattccacaaacagaccagagttccgaatattcttcaattaaaaagaatactaaaattttacaagatactttaaatagttttggagttgatgcttccgttgaaagcgtgaagatggggccttctgtgacggaatacgaaattcatccagcgattggtgttaaagttagtaaaattgttggcttggccgatgacttagcgttagctctagccgcaaaagatattcgtattgaagctccaattccgggaaagtcattaattggaattgaggttcctaatcgaacaatttcgacagtttcatttagagacattattgaatctcaaccggcccatccagaagacccacttaaagttcctgttggtcgagatgtttcgggtaatctagtagaagctaacttagttaaaatgcagcatttactaattgcgggagctacaggttctggaaaatcagtgatgattaatgtcattattaccggaatcttaatgaatgctcgtccagatgaggttaaattaattctaattgatcctaagaaggtagaacttggaatctataatgacattccgcatctactaaccccagtggtgaccgatgctagaaaagctgctaaagcgctgcataaggtggtcgcagagatgcaacatcgatatgatttgtttgctgaattaaatcaacgaaatattaaaagctacaatgatttcatcgaaggacagaatgcagcagacgggatgaatcgtccaaaaatgccatatattgtggttgtagttgatgaactttctgatttaatgatggtagcttccaatgaagttgaagatgcaattattaggctggcacagcttgcacgtgctgcaggaatacatatgattattgcgacacaacgtccgtccgttaacgtggttaccggtttgattaaagctaatgtgccatccagaattgcctttgcggtagcgtcgggaatcgattcgagaacaatcattgatgctaatggagcagagaagttattaggaagaggagatatgttgttctttccgatgggtcagaacaagcctgaacgtgtacaaggggcatttatttcggatcatgatgttaaggagattattgattttgttaagaaacaacaatctgctgactatgatgaaactttagatattagtgaccaagaaattgaagaaaatgatagtggagaattagatgagtattatgcggaagctgttcaattagtaacagatatgcaaagggcaagtacttcaatgcttcaaaggaagttccgagtgggatataatcgcgctgcccgtattatggatcaacttgaagataatggtatcatcggtcctcaagaaggtagtaaacctcgtaaggtatatcgtgaaaaagaataaaaaagatttaagacaatctgtcttaaatcttttttttatattctgattaatttgcaccaaacaattgagccagaggagcgtaaagcacacttcccaaggtcaagataatcataatccaaacaaaaatcatgatggttttttgtaaaccgcttttctttttctttttattatacattcaaaacactactttcttgattgacttaggataattttacaataagtgtatttttaaggcaaattagaaaaaatccccacctcgaaatgattacttttatggctaagaactattgataaattcatactttttctaagtatgttaatttttttcaaataaaagaaaaacattcgggttttaagtggtggaaagtggggggaagtggtaatattgttatagatttagttgacggaggcggtttcatgttcatgggtgaatttgagcattcacttgattcaaaaggacgtctaatcattccatctaaatttcgagatcaactggatagcaactttgttgttacgagagggctggatggatgcttatttgtctatcctttgtctgaatggcgtctagttgaggagaagctcggtcaactaccttctaataagaagaataatcgtgcatttgtacgttttatgtttgcagatgctgtccaatgtgattttgataagcaaggaagaattattattcctaaaaaactgagattacatgcggaattacaaaaagaatgtgtcctggtgggggtttctaatcgggttgagatatggaataaagcccgctgggaagaaactattgaagaaactgaagaaaacttcgacgatatcgccgaaaatttaattgactttggattgtgataaatatgacggaatttaaacatacaacggttctcttagaagagaccgttaacggcttagatgtaaaagaagatggtatttatgtagactgcaccctaggtggcggtggacatagtagactaattttgtctaagttgggagaaaatggtcacctctattcatttgaccaagatcaaacggcaattgattacaatcaaaaaaatttagcagaatatgttgctaagggacaagttacttttgtaaaatcaaattttcgtaatttaaagaatgaattaaaccacttggggattgatggagttgatggcgttttatacgatttaggcgtttcatcaccccagtttgacgacgcagaacgaggatttagttatcgatttgatgctcctttagacatgcgtatggatcaaactcaaaaattgaatgctagagaagttgttaatgaatggagctataacgatttagtacgaattttctttagatacggagaagaaaaatattctaagcaagttgctcgaaaaattgaaagtactcgcgaagaaaagcccattgaaactactggtgaactagccgatttaattaaaagcgcaatcccggcggcagcaaggcgaacgggtggacatcctgctaaaaagattttccaggccattcgaattgcggttaatgatgaattgggtgctttagaagaatcattggaacaagccctacaaattttgaatccagcaggacgtatttcggttattactttccaatcattagaagatcggttagtaaagagaatgtttaaagaacaaactgagattggtgatttaccggctggactgccaattatcccagatgatatgaaaccaaaatacaagttgatcaataggaagccgattattccttctgaagatgaacttgaagaaaacagaagatcacatagcgcaaaactaagaattatcgaaaagttatagaagggatagacgccaatggctcaaaataattatgctggccgtagaacaaaattaattaacgacacagtaattacgggcattagtgaaaaagaattaaaaagagcacgtgaggttgtaactgctaggcaattaccactttcaaaatttgaaaagattttgataacaatttgtggttttattctagtggggttaatgctaacagttgtttctggtaaaataggattatctactgcacaacataatcttgaaacaactcaagagaaagcgacggccttatcaagtaaaaatacgattatggaacaggaaattaatcaattgtctgaccaaagtcggttgaacaaaattgctaaaaaggcaggcctttctctcaactctgagaatataaggaatgtaaataaatgatgaaccgaaaaaagcgaacaactggtactacggaaactcaacacaatcggaaaatgtttggtaaatggctattattgattgtgattggagtatttatagttattgttgggcgcttttcttatattgccgtaagtggcactgtcgaaagtgttaacttaagtagtcaagcaaagcgtttgtataccgataataaaacaattaaagccaaaagaggatctattttagatacgaatggcaatccgattgccgaagacacaagtacatattcagtttacgcagttgtaagtaagaagcaggtaggagcaaataacaagccgctttatgtcaccaataagaaaaagacggctaaagtacttagcaaatatctaccaattagctatcacaaggctttaaaaactcttagtcccagcaatagtaaaacgttccaagttgaatttggaaatgtgggaagcaatatttctgtggcgactaaagaaaaaatagaaaaagaaaaattaaacggaattaactttgtttcatctgaagctcggttatatcctaatggaacttttgcttcaaatttgattggttttgctcaacaatctcaacaaaaggaaaatgatgcgactcaactttctggcgttatgggaattgaaaaaatgagtaacaaaactttaacggggactgatggtgaacaatcgttgcaaaaagataagtttggctaccagctcccaggatcccagactgagcgtccagcacgcgacggaagcacaatctatactactattgaccagcgtttacaaaacatcatggaaaatgtggtaagtaaagttcaatcagaatcggaatcacaggcaattagcgcaacaattatgaatgccaaaacgggagcaattttagccacaacacaacgaccaacctttaatgcttcaactaaaaaaggactttctaaagcatggaataatgcgctagttcaggatacctttgaaccaggttcaaccatgaaaatctttactacttctgcggccattgatagtggtaattttgactcggatgccacttatcgttctggaacctataccatcgatggtaaagttgttccagattggaagacagaagggtggggcgtaattagttacgcaaaaggatttgccttatcaagtaacgtcgctatggctcacttagaacaaaatatgggagctaagacatggaagaaatacattaatcgttttaaactgttgcaatccactaattctggtttggaaagcgaatctaaaggtagtattcaattcgactatccgattgaacaagctaacacagcttttggtcaagcaatcaatgtgaccgcaatccagatgttacaaggttttacagcagttgctaataatggaaaaatggttaagcctcaatttatcaaaaaggtagttgatccgaatactggtaaaacaacttataaaatgaagacaaaagatgtaggacggccaattaaggctagtactgctaaaaaggttcgaaaactaatggaggatgtagtctacaaaccatatggtatcggctcaaacttcaaaattaaaggttataaaattgcagctaaaacaggtactgcccaagttgcgaatgcaagtggaggatattcaatgggcgatgacagttatctgtattcagtcgctgggatggccccggccaaaaatcctaagtacataatgtacattacgatgaaaaagccagtgctcaaagataaaactgccacacaattacttgatgaaatatttggtccagtgatgaaacaagcccttgaacaggataaggaaactgataagtcaaagctcgacagctcaattgaagtacctaatttagttggcaaggatgcttctgaagccaaaaaagaattgggtaagaagaatgtggcagttgttacattaggaaatgggcaaactgttaaagaacagtccgagagtgcaggaagtagtattctagtggggcaacgagttatcttagacactggtggaaccataactatgcctgatcttacagggtggtcaaaaaatgatgttataaaattagctaacatgtttgatattgatgtgaaatatagcgggaatggttttgtttctgggcaatcggtggccaagggtggtccaataaaatctggcatgaccatgactgtaagtcttaagaagtagagattaggagagaaaaatgattaatggaacagctttaatactaggtgcgctagtaacattagtggggatgccccaatttataaattactttagagtccggaatgaaggacagatgattcgtgaagagggacctaaatggcatcaaaaaaaatctggaacaccaaccatgggtggaatggtgtttatcattgctatcattattgctagtttagtaactggtgtgattttccacggggcaaaagtgagccttttaatgttactttttgttttagttgaatttggattgattggttgctgggatgatagtattaagttgttaaagcgccaaaatgaaggttttaaagcttggcaaaagcttttaggacaaattattggaggactaattttctttctagtgattaaggagactggagtggcattacaattaaatatccctggcttaggtatttggcacctaggcggctggtatgcattgtttgttattttctggttaactggattttccaatgccgtaaatctttcagatggattagatggattagtagcaggattatcgacgattgcttttggaacgtatgcaattattgcagctcaccaacaaaatattccagtaatgattttctgtatggcagtagtgggctcaatgctaggattcttagtttttaaccataaaccagctaaaatttttatgggtgatatgggatctcttgccttagggggagctttggcagctgtctcaattcttttaaatcaggagttatcattgattttaatcgggattgtttttgtactagaaactttaagtgttattctccaagtactttcttttaaattaactggacatcgtatttttaaaatgagtccgattcatcatcattttgaaatgttaggttggagcgaatggaaagtagatattgtattttggatagttggtttaatcggatccataattacgttaattagtattttatagggagtctttaatgatgaagtcagtagaagatttggaagataaaaatgttctagttttaggaatggccaagagcggagtaagcgccgctcttttattacatagattaagagcaaatgttttagttaatgatgctaacgctaatcagccacaagaattaattgaaaagcttgagaacaaaggtatccggatggtactaggggaacatccaaccaatattttaagtcaaaataaaattgagttgattgttaaaaatccgggcattccttatacgaatcccgttctagtcgacgcacaagccagaggtataaaaattgtttctgaacctgaattagcatactgggtaatggatagtgagttgatcggggttacaggaagtaacgggaaaacaaccgtaacaacgctaattcaattgatgcttgacgataataaaaaacatgcttatgttgccggaaatattggagttcctgctacaacagttgctcaaaaggccactgcagaagataaaatagtgatggaattatctagctttatgttagctggtattgatcgacttcatccacatattgcagttttgaataacatttttgctagtcacttagactggcataaaacacgtgaaaactacgttaatgacaagatgaatattactaagaatcagaccaaggacgatttcttggtaatcaattgggataatactgaatggcaagaactagctaaaagaactcaggcgaaagtagttccgttttcacgtcaaggactgactaagagcggtgcgtacgaaattgaaggcaaactttattttaaagatgaattaattatggaagtcgatgaaattggaattcctggtgaacaaaatgtcgaaaatgcactagccgctatcgcagtagctaaaatcgaaaaagtcagcacagctcatattaaacaggttttgacaacttttggtggagtaaaacatcgaattcaatatgttgaaaacctcaatgggcgtcaattctataatgattctaaagcaactgatatcgaagctacccaagtagccttacgttcttttaaaaaaccagtgatattaattgcaggtggattagaccgacatgacgatttagatcgtttaattccagacttagagccaaatgtaaaagaagttattgttaatggcgaaactgctgagaaattcaaaaaaatagctcaaaaagccggtatttcagtaattaaagatagttctagagtaagtgaatcggttgaaatagcgtatcaagatagtaaagaaggggatattatcttactttcaccggcagcggctagttgggatcaatacaaaacatttgaagaacgtggtgacgaatttattgcagcagttcaaaatttacataaaggggaataattaaatgagactgatggtttctggtggtggaactggtggacatatttatccagccctagcactgattaaacaagttaaacaaagtgaacctgattcacagattttgtacgttggtacaagtaagggattagaaagtaaaattgtcccagatagtggaattgattttaaaaccataaatatccaaggattcaaacgttcactttcacttgaaaattttaagacaatcggacttttcttaagtagcgtggttaaagcgcgtaagatggttaaggaatttaaaccagatgtagtcttgggaacggggggctacgttagtggtgcggttgtatttgcagctagtatgatgggtgtacctactgtgattcacgaacaaaatagtgtggttggcgttaccaacaagtttttgagtaagttcgttaaaaaaattgctatttcgtttgaggcggctgcaagtcaatttcctaccaagaaagttgtgttaactggtaatcctcgcgctactgaagtagcacagattaaaccaagtggactaagtcaatttggtctagacgataaggtgcctaccgtattgatttttggtggaagccgtggagctgagaagattaatcaggtcactatcgacaccttggaagaattaatggaacgtccatatcaaacaatatttgtaacaggaagagttcatttcgaacgtttaaccaaagatattgatttggctaaatatcaaggcaaaatagctattttaccttacattgcaaatatgccagaaattctttccaatatggaagtaattgtggggcgagctggagcaactagtttagcagaaattacttctttaggaataccgtcaattttaattcctagcccatatgtaaccaatgatcatcaaacaaaaaatgcaatgagtctggttaataatgatgcagcagagattatcaaagaaagtgatcttacttccgaagcattgattaatacgcttgatacattgatgctagatcagaaatttcgaaacgtaatggcagaaaacgctaagaaaatgggtcaaccacgtgctgctgaaaatctttatgatgttttgaaatcggttagtaagtagatataggtagtaagatgaaaaagaagaaggatgaagaattaactccgtgggccaaatatcaaaaagaacataatgcaaatagtagaagcagatttaagcggaaacgcaaagccacttcgaaaaatccacgcgaacctcaagcttcttttagaagaaataatcgaaacaaggttaaaaaatcaaataaaaaaggcaccaaaagaatagtaaaagaacaacggctttccagacaaaaactgggaatattaattggaagtacgttgatagtgatcgccttattttttggttatttttattcttcaattagtcgagttcaaaaatttagtgtaagcggtaataagcgtgtttccactgctaaaattttaaaaaatgtgtctatcaaaaaaaatgatgtaattttaacttccgtatttaaggaaggaaaatttgaaaataatcttttaaagaaaaatacagacatcaaagatgctaccgtatccatttcatggagtggcaaagttaaaattaaagttaaagaaaacgcggtcatgggatatgtaataagaaacaagacttattacaccgtaaaacaagatggttcggttgttaggaagagtgttagtcaaccaagttcggattacccaatcttcagaaatttccaagaaaatagtacacttaaaaagtttttgaaggaatatgcccagatgccaaatagtgttcaaaatgatgtagcagaagtcgatttttcaccgactaaaaatgttaaggatcgtctacattttttcatgaatgatggaaatcaagtgtacgctattatgagtacatttgctaaaaaaatgaagtattaccccgaaatttcagcaagtatgaaagaacggggaatggttgatttacaagtaggagctttttctagacctagcggttggacagatgaggctaaagcagccagtgaatcgtctaaaagtgccgaatctagtagcaaagctaaaaagcaggaaaaaacgacacaaaatagtgaaagtgccgattctaccagtggttcagcagattcaaccgaaacaattaattcagcaagctcacaaagtaaagaagacttagaaagctcaaatgctgaaagtacagtaaatactcaacaagatatagattaataaatctgttaatttattcttaacatcaaattgaaacttaagatggataagatgctcttagataaaaatcgtttaatccactaaagggtcaaacgatttttaagtgctattggttgcgttagaataagttttttaattgaaaaactatcagttttggagcggattaaaaaaataattgtttatgaataagtatttcctatttttatacaagaattgatattaatatggtaaactgtttaatatatgtgatgaatatatatataagaaacggttaaacgactaggaggttcctttattatggataattcaggaatttacgttggactggatattggaaccacctcaataaaagttattgttgctgaatatgtcaaaggacaaatgaacgttattggtgtgggaagagagccctcagatggtgtaaatcgtggtgttattgttgatatcgacaaagcctcaattgcaattaaaagggccgttgagtctgcagaacgcaaggcaaatattcaaatccacgacgtagtagctggtattccagctaatttattaagaatagaacctgtcagaggtatgatagctatctcagatagctcaagggagattggaaatcaagatgtagttgaagtttcaaatgcagcttcagtacataatcttcctcccgaacaggaagtggttgatgttttacctgacgaatttatcgttgatggttttgatggcattaaagaccctcgtggaatggtcggtgttcgacttgagatgaatgggggattgattactggtcctaagaccattattcataatttaaagagcgcaatccgtcaagctggtttaggattagtagatgtagtcgttagtccactggctcttggcagaacaattttaaatgatggtgaacaagattttggtacgattactcttgatttgggtgcaggacaatcaactgccgctgtgatccatgatcatcatcttaagtacacgttcgttgaacaagaaggcggacaatttgtaactaaagatatctcggtagtattaaatacttcgttagataatgcagaacaaattaaacaacagtatggttatgctgttgctgatcaagcaagtagtgatgcatttccagtaaatgttgttggtcaaaatgaaccggttgcagttactgagaaatatttaagtgaaattattgaagctcgaatggaacaaatattaactaacataaaaaaacaattagaaaaagtaggggctctggatatgccgggtggtgtcgtcattaccggcgggggagctgcccttcctggaatcgaaacgttagttggaagaatttttgaaacaaatgctaaactatatgttccagatcaaatgggtctaagacatcctgcttttgcgcaagctcttgctattttgaattatgaaggtcgcatgagcgatgttgagattttagctaaaacagcaatggtttcaagcgaaagaaccgtatcagaaacaccgcaagatgatgttgttgatgaaaagcctaaatttaaacaacgcacaaaatcatcagagagacgtcccgaatcacaacaagaacggcctaagccaacaactaataattcatcatcaagcacagcaaactcaaatcgcttcgatggtatcaaaaaatggtttagtgatttctttgactaactaatcgatggaggaattaacatggaattttcaatggacgaaagtaaaagtacaggcgcaaacatcaaggtaattggtgttggtggcggtggtgggaatgccgttaaccgcatgatcgctgaaggcgtaaagggagtagaatttatcgttgctaacactgacgttcaagctttacaagcttcaaacgcagacgttaagattcaattaggacctaagttaactaaaggtctaggagccggttcaacacctgatgttggtgctaaggctgctgaagaaagtcaacaaaccatttcctctgctcttgaaggagcagatatgatttttgttacagcaggaatgggtggtggtaccggtacaggtgctgcacctatggtagctcaaattgccaaagagcaaggtgctttaacggtgggtgtggtaacacgtccatttacatttgaaggacctaaacgtgctcgatttgcagcagaaggtgttgcaaatcttaaagaacatgttgatacgcttattatcattgctaataaccgcttactagatttagttgataagaaaactccaatgatggaagcatttaacgaagctgataatgtattacgtcaaggtgttcaaggtatctctgatttgattacatcacctggctacgttaacttggacttcgctgatgttaagacagttatgcaaaatcaaggctcagctcttatgggaattggctcagctagcggcgaaaacagaacagaagaggctacaaagaaggctatttcatcgccactgctcgaaacatcaattgatggtgctgaacaagttcttcttaatattactggtggtccagacctttcattatttgaagcacaagcagcttcacaaattgttacggaagcagctaatgatgatgtaaatatcatcttcggtacttctattgataatgatttacaagatggggtacgagtaactgtaattgctacaggtattgataaaaaagctggtagagcgtctttacaccgtcaaccagcacgcacctcttttgaaacaccaagcagtagcgtaaatactactacaacaaatgtttcaaataatactgaaattcgcggtgctggttctacagaaagtttaaacacgtcatctaatagtgaacaacctactcaagctgctaatgatccatttggtgactggcaattacgtcaatcaaatgcttcaaatggggttcgtcctacttcacgcgataacgatagttttagaaatgttgaaaagaaagaattcaacgcttttaacgataataacaatattagctctgacgatgattcattggatacacctccatttttcaaacgtcgtggcaaataaaatataataaaagggtttgggctaagctcaagcccgtttattgcaattaggacaaaatattgaaatgagtgatagaaaataatgattacagtaatcttccaattgttacattgggccattcaattgtatatgttagcaatctttgtgtgggttttgatgtcttggcttccaggagcttatcaatccggcttgggaaagttgcttactaaaatttgtcagccttatatgagttggtttagatttattccacctatctttggaatagatttttcgccgatattagctttgttagttcttgaactgtgtgcaaatggattagtttttcttgaaaccttaatgcttggtgtaatttaactatggataatcaaattacacagcattttagaaaagaagagcaggaattaattgagagcttttcatcttcactccaagaggctttagatcaaaatcgtccaattttaactaattttttaaatccccgagaacaacatattctccaaaccctagttaatcgatttcctgaactaaaggtttattttaatggagggtttagcgaggcagaaaataagcgagcattgattacaccagattattttgttcctgcggaagatgatttttctgttagaatctttgaaattaattatccaattaattttacagatttagaacatcgtcagattttaggaacattggttaatgctggtattaaacgaagtacttttggtgatatagttcatcaagcagaacgctggcaatttgctgtcaatggagaattagaaaatttctttttaaatgaaattgatcgaattggtaaaataaaagttaaattgattcctacttcaacaaatgatattttaaaagttcaagatgattgggagcctgttaaccagactgtagcatctttaagaatggattcaattatttcaacaggattttcgatctctcgtcatcgagtgaaagaactgattgaaaaacgtttagttcaattaaattggatgattgatgagaaagctgatactttaattgcgttaaatgatgttatttcagttcgaaaatatggtaggataaaacttgttgatattcttggaaaaacaaaaaaagataaacttaagatccagctggatataatcaaaactagatagtgagttatgggggttttattaaaatgtcaattgaaccacaagatatacaacaaaaacaattttcaaataaaatgcgaggatacaatccagtcgaagttgatgaatttttagacgaagttgcgtttgaacagcgtcgtcttcatgatgaaatcgatacacttcgttcacaacttaacgaggctaaaagtcgaattgattattttgatgagatgaaagaatccctcaataagtcaattatggtggcacaagatgcagctgataaagtcaaaatcagttcaaaacgcgaagccgaatttacttctaaagaagcccagaaagaggctaagtcattaattgatgcggctcataagaaagctgatagttacatcggtgaagcggctggtaaagctcaaaaggttgtaattgctactgatgatttgaagaagcaagctcgtagtttccgtcaaaaatttgaagttttactagagtcacaacttcaaatgattaagggacgtgactgggataatctgcttagttcagatgaactactcaccattggtgaaattaaagaagccatgcgtaatagtggtacgcttgacaacttccaagatgagagtgtacactcagaggaagttgccgaagttactccagatactccagcagttgaacctgaagtacaagatgatcaacaaaccgttgtagttttcccagaagactacaataatgagaatggtaatccaactagtgaaggattccatgtcaaaccaaaagaataaaacgttaaaaaagaagaatcttcaaaatgtagcatcttagcgagctgacgacggtgggaggtcagtatgtaatttgaaggttgatcacttttgagtgctagattgaaattcagtaaatctagtcggttggcaaccgttaagtgctacaaagaggaagaccatttaatggtctttaaatttgggtggtaccgcgaagacttcgtccctgttaagggatggagtctttttattttacttggaaaggcgagtggttttagtgcgagttaaagatacattaaaccttggaaaaacaaaatttaaaatgcgtggaaatcttccagttaatgagcaaaaacgtgaagatatctgggctgaaaataaaatttatgaacaacgtcaaaaattaaatgaaggcaaaccatccttcgttttacatgatgggcctccatatgcaaatggaaatattcatatgggacacgccatgaataagatttcaaaagatattattgttcgttacaagtcaatgagtggttttagaagcccgttcgttcccggctgggatacccatggacttccaattgaacaacagcttactaaggaaggctatgacagaaaaaaaatgtctacagctgattttagaaagctatgtcatgaatatgcgttaaaacaggttgataaacaacgtactgattttaaacgtttaggtatttctgctgaatgggatcatccatatttgacacttaatccggaatttgaagcacaagaaattagaacatttggtcgaatggccgagctcggattaatttatcgtggtaagaagccggtattctggtcatggtcatctgaatcagcgatggccgaagcagaagtagaatatcatgatgttacttcaccatctgcattttacgcagaaaaagttagtgacggaaaaggcgttcttgatgaaaacacttattttgtagtttggacaactacaccttggacaatcccagcttcagaaggaattacgattgatgctggttttgattattcagttgttcaaccagccggtgaagatcgtaaatttgtgattgctacagatcgtttaaattatgctgcggaacaatttggttgggaagatgttcaaacccttcaagttatccgtggccgtgaattagaccgtatcaaggctatccatccatttgacaacgatcgcgaactagttgttatgttaggtgattttgttactttagattctggaactgggttagttcatactgcaccaggttttggtgaagatgacttccgtgtaggtaaggaatatggattagatatttttgtaccagtagatgatcgtggctacatgacagctgaagctggaccagattttgaaggtgtcttttatgaagatgctaatgcaattgcattggacaaattaaaagcttctaatgctttattaaaacaaatggactatgtgcatagttatccatttgattggcggactaagaaaccaatcattttccgcgcaacgcctcaatggtttgcatctgtagataagattcgtgatcagattttggaagctattgaagatgttgaatttcttcctgactggggtcaaaagcggcttcacaatatgattcgggaccgtggtgattgggttatctctcgtcaacgtgtttggggagttcctttgccaattttctatgctgaagatggtacaccaattcttgaaaaagaaacgattaatcatgttgcagatttattcgagaagaacggttcggatatttggttccaatgggaagcaaaggatcttcttccagaaggctactccaacgagcattcaccaaatggcgagtttactaaagaaaatgatattatggatgtttggtttgattcagggtcatctcatcaaggagttttggcacaacgcgattatcttgaatacccagctgacttggtattggaaggttctgatcagtaccgtggttggttcaattctagtttgattacaagtgtggctgtatcaggcaaggctccttataaaaaagttatttcacaaggatttactttagatggtaagggccataagatgagtaaatcacttggtaataccattgttcctgatgaaattaacaagaagatgggtgctgaaatcattcgtctctgggtttcttcaattgattcttcatcagacgttcgagtttctcaagaaaactttgtaaaggcctctgaatcatataagaagattcgcaataccgttcgctacttacttgcaaatacttctgactttgatccgaaggaaaatggcgtagattataatgaattgcgtccagaagaccgttatatgctagttcagttcaatgaattgattagtaagattcgtgcttcatatgataactatgacttcatcgacatctacaaaacattgttgaactatattattacggatttatctgcattttatttagatttcgctaaagatgtcgtttatattgaacctgaaaatagtttaaaacgtcgttctatgcaaactgttttctatgaaattctggttgggttgacgaaattaattacaccaattttgccacatacagcagaagaaatttgggaataccttcgtgaaccagaagaatttgttcaattagctgaaatgccggaagttgctaactatacagatggtgcagatttactaagcaaatggcaaagtattaaggaactgcgctcacatgtattaaaggcgcttgaagaagctcgtgatagtaaaatgattggtaaatcaatggaagctaaggctaccttatacttagacgaatccactaagcaattagtagatggactaggggttgacttgcgtttgattttgattgtttcacaattagaagcaaaggcattatcagaagctccaaaagatgcagcaatttttgacgatcaattagcagtcgaaattacacctgctcaaggggaagtttgcgaacgttgccgaatgacaaaaactgatgttggttcagacgaacactttgctacgctatgtgctagttgtgcccaaatcgttactgaaaattaccctgaagcaattactgaagggtttgaagaaaaataattaattaagaatgattaggcgagtaacctaatcatttttaatttacagaagtgttttccaccattatgatggtagtatgacaaacataaaaagggagctgaaattttggaaactggaacagtagaaagctttgataaagaaaaagggtatggatttattgaaacggctagtggagataaagtattcgcacattacacggtcattcaatctgaagattataaaactttagaagtcggtgaaaaggttaagttaatgcttgcagatgggccaaaaggattaatcgcggttaaagtttttcgtgaggaggctgaataataatgagttttgaagaaaaagtagtagagtctatttcaagatataaaggtgaagttattgatgtttatcaacaaacggtgaaattaccagatggcgaattggctaatcgagatgttgttaagcaccaaggagctgtgggagttttagccttaaccaatgacggtaaggcgatctttgaagaacaatggcgtacaccaattggcaagttaacaattgaaatcccagctggtaaagttgaaccgggtgaagatttacttgagacagctaaacgagagttgaacgaagaaacccgctatgaagctgggaagattgaaaaaattaatggtttttattctgctccaggcttttcaaatgaatatatgactttgtataaagcaaccaatttaaggaaagtcgctaaggaacttcctcgtgatcaaggtgaaaacttaaatatttttgaactttcattggatgaggcattaaaagctgttgctgaaggtaaaattgaagatgcaaaaacaattttagctatttattattggaaggctaacattaagtaggtgaggctttggataagaaaaaacaaactcgtgctgaataccaaaggagtttgcaaaaagaaacagaacaactaaatgcagagcaaactgtagatgaagaattatcacgtagccaaagaaaacagcgtgagactaaagatcagcgcttcaatccagacgaacagtcggaagcaaaaagccgggcattggctaagaagttaaacatcgcaatagcaggattaggaattggaatcatattagttttcttaattttattttttgtaggataggtgagtaaagtatgaaatatggtgtaatttgtgccatggaagaagaaattaagacgcttcttgacacgctagaacttgaaaaagaaaccaatatcaatggaatcattttttatgaaggaaaaattagtaatgtagatgtagttctggtgcgttcgggaatcggtaaagttgaggctggaattacagcagcaattttagttaccaattttaacgcagatgccttaattcattcaggttctgcaggcggaattggggaaggactagaagttggagacgtggtgctatcaactgaagtggcgtaccacgacgtagatgcaacagcatttggctatgaatatggtcaactcccacaacaagacagtgctagatttaaggctgatgcgtcattgattcatcaatttgaattagcagctcagaatcgtaatttaaatacaaaaaaaggtctaattgttactggtgatcaatttattgctagtgctgataaagttaaaactattctaaaaaactttccagatgctttatgttgtgaaatggaaggtgcggcagtcggacaggtggctcatcaatttgacaaaccatttattgtggtacgtgctatgtctgataccggtagtgatgatgcggatgtttcttttgacgaatttattattgacgctggaaagcgctccgcatcaatgctgattgatttatttaagatggaagggaataaataatgcaacaagtatatttagataatgcagctacaacgccaacggatgccgcggtagttgaagtaatatctaatgaattattaaataactggggtaatgcatctagtttacatggcttcggtcgtcgagctcgagctacacttgacgaagctaggcatataatcgcacaaagtattcatgcgaatgatgatgaaattatctttactagtggtggcacggagagtaataacactgccattacacaagtcgctttacgtaatcaagataaaggtaaaaaaattattactactgcaattgaacatccatcagttttgaaccccatgcgtcgtttagaaagtatgggatttgaagttacttatttaggggtcgatcaaagtggattgattagtttggatgaatttaaaaatgcgctagatgaccaaacaatcttagtaagtattatgactggtaacaatgaagttggtagccatatgccaattcatgaaattggtgaaatattgaaaaatcatcaagcagtattgcataccgatgcagtacaagcctacgggttagtagatattgatgttaagcgtgaccacattgatttattatcaacttcagcccacaagttgaacggtccaaaaatgatgggcttcttgtataaaaacaacgaagttaatttcgatagctttatattaggcggcgaacaagaagacaagcggcgtgcaggtacagaaaatgttgccaatattgctggatttgctaaggctgttagtttgcttgatgcagaccaaaagaatcaattgcaggctcgttatgccggttttaagcaaaaaatcattcaaactttaaaagaaaatgaaattgaatttgaaatcaatggttcgttagatgaaaacaacctccaacatgtttttaacatttggttgaagggagtttcaacttacgtaatgcaaactaaccttgatcttgccggaatcgctatatcaggtggatcagcttgtaccgctggaagcttagaaccatcacatgtattgacggcgatgtatggtgaggattcacctcgcattagtgaatcgattcgaattagcttcggtaaaaagactacggaagaagatattgagtatctgtgtgatcagattgtagcaattgaacaacgattaaaacaaataagcaataaatagaagcgaggggttcagatggcttttactaaagaagtgaatgttaagggcgataatgtcatttacacgttaaatgctaatataaaaaaatatactttattagacttaggattcacgactaagaataatggaacattcgttttagaacgttcgttagattcaacttcaccctttaaccaagggattaaattaaagataatgattaaaccagatttctctggatttaaaatgagtacaaccacagctaatggaatgcaaagtgttaacatttttagtcgagaacaggatgcaccattagttgaacagtaccattttttgattcaagaattacttgaaagagaagtattggctaaaaaatagttactaactttttgttaatggtggaatttaataagtgtttggtataaaatggattttactggatttatgcgaccttcaatcgtagattctccagaatctgatagaaatgatggtgataaatatgactgacaacagtaagacacgtgtcgttgttggtatgagtggtggtgtggattcatctgtagttgcatacttgctaaagcagcagggatacgatgtagtaggtgttttcatgaaaaactgggatgatactgatgaaaatgggtattgtacagctaccgaagattataaagatgttgcaaaagttgcagctaagattggtattccttattattctgttaactttgagaaggaatattgggaccgagtgtttacttatttcttagatgaatacaaaaaaggacgtacaccaaatcctgatgttatttgtaataatgaaattaagtttaaagctttccttgactatgcgattagtttaggtgcggattacgtagctactggacattatgcccaagttgagcgtgatgagaatggtcaccaacatctccttcgagctacagatagcaataaggatcaaacatacttcttaagtcaattaagtgctgaacagttagatcgagtaatgttcccacttggtggaatgattaagcctgaggttcgtaaggttgctgaagaagctggactatcagtttatgataagaaggattctgtcggtatttgctttatcggtgagaaaaatttccgcgaattcttaggaaattatcttccagctaaggctggtaagatgatgacactcgatggtgaagtaaagggtgagcatgctggcttaatgtactatactattggacaacgtcgtgggcttggtatcggtggtggatctaagaataatgagccttggtttgtagttggtaaggatctttctaagaatatcttgtacgttggacaaggttttgaaaacagtcatctttatgctgctagtttggatgcatctgacatgcattttgtgaataagttaggtgaagaacgaggccgtgatttccgctgtacagctaagttccgttatcgtgcgcaagatgtacctgtaacagttcattttagtgaagacttttcaaaagttacagtagattttgatgatccagctcgtgcaattactcctggacaagcgcttgtgctttacgatggtgaggaatgtattggtggcggaatcattgatgctgcatacaatagtgaaaagaagatgttacaatacatctaatttaaaaagaatcagacttagtctggttctttttttgttttttggtaacctaggattcatttaatgttaaaattattagtaactatgtaaaagaaggacaagaattttgacgaaattatattttattagacacggtaaaacagaatggaatttagagggacgctatcaaggtgccaatggtgattctccactattgaaagaaagctacacggaaatttcacaattagctagttttcttgcacctaataaatttcaacatatttatgccagtcctttacgacgtgctagagtaacagctacgacattacaacatgagttggatgaattacaaggttatccaacgccaattactatttctagtaggttaaaagagttcaatctaggtattatggaaggaatgaaattcgtcgatgttgagcgggaatatacagatgaagtggatgcattcagaaaccacccagatcgttatgatcctaccaaaattaagggagaaacttttcaacatttagtaaaacgtatgaaacctactattttgcgtatttgtgaaaagtatcctgctaaaaatgataatgtaattatagtaagccacggagcggctttaaatgctctaattaattcactattagaggttccgttagctgatttaaggaaacgtggcggtttagccaatacgagtacgactgtcctagcaagtaatgacttaggaaagtcttttgaattagttgattggaataatactagttacttaaagaagcgcattgacccaacagatgtaatttaatgtaggtgaaaaaatgactgaagataagaaaaaacaagatatagttaaagatttgattgataaaatcgatcaaaatccgcaagaagctgaaaattattatgcgttagctacggttttggttaaacaacaaagttttgaccaagctgaagaacttttagtaaaagctcgaggtttatttaaagattcgcatagcgtcgatttattaacatacggtttgggaaatgtttattatgaatctggactctatgagaaggctaatgtagaatttcaaactattaaagatgcacatttaaaaaaagatgctaatttaatgattgctcagggttactatgctcaaagtcagtacaaattagcttttgcttttggactaactgcgttagaacagaatccccacgatgctgatacaaatgaattaatgggtgatgttaatttagccctaggggatgctccaagggcccaaaagtattatgatgcggcgttagaaaataaaaatacagctaagttactatttaaccgtggtgtagttgaaatgacgttaactaaaaagaaaacaaacatttattttgaacaagcaaaaaaaattgataaaacgtattttgaaagtagcaaacaacgattaattgatatcgataaattactaagtgaatctaaggaagatgtttaatggcatttgagaaaatgaatttatttggcgatgctgacccaaaaaagcagtctcaaaataagatggtcgaactgattggtgaaattagtgcggtcttttttgagagcccagatagtttatttaaagtgctcctggttactgtagaagaagatgattttgactggtccgaagagcagattgttgttactggaaatattggtgacgtacaagaaggacagaagtatcaatttaatggaaaactaattgcacatcctaagtatggtatgcaaattcaagctaatcaatatcgagcatttatgccaaatacagaagatggtgttgttacatatttgtcgggatcacaattcaaaggaattggaacgaaaaccgctgaaaaaattgttgaagctttgggatcggatgcacttaatgaaattaagaaagaccctggagttttaaacggtctaaaccttaaagaaaagcaaattgatatgattgtatcggttttggaccagtccaatggattagaggatatccttataaagctcagtgatatggggattacaggaaaaattgctagtagtatcgtaaataaataccatgaggatgcaattaacatcattgaagagaatccctaccgattggtcgaggatatcgaaaatattggttttaaacgagctgatgctatcgctgctagcttaaatattaaaccggattttgaaaaacgaattcaagcaggaattttagaagcaattaaaacttggtgtaatgccacaggtgatacttatattttggcagatatgctactccaagaagcccgaaagcttttaggtacggctgtaaatgctgaagctattgcagatcaagttttacagctaggtaaagatggaaaagtcgtaggtgaggacggccaaatttatctgaaatggttatataatgctgaagtcgctattagttataacgttaaacgcatggtcggtgaatcgaattcgaacgttaaaggtattaggcgggcaatcaaagccgctgaaaagaatctaaatttaaagtatgatgatacgcagaatgcagcgattgaacttgcactttcacaccctatgacaattattactggtggcccagggacagggaagactacaattgttaaggggttaattaatagctttgcagaattaaatgatatttcgttggatattaacgaatatacggaaagcaaattccccattcagttagcagccccaactggtcgagcagctaaaagattaagccaagttacgaatgtaccagctaaaactattcatcgtttgctagggttaaatggaaatgacgatctccagaatgatgaaataaagcagcttgaaggcgatttgttagttatcgacgagatgtctatggttgatactggattatttagtacgttggttaatgccattaatccagatatgcaagtggtattggtaggagataaagaccaattaccatcagttggaccaggacaaatatttaatgatttaattaaaagtggtaaaattccaaccatttcgttaacgaaaatttatcgtcaagaacaagattcatcgattattcagttagcccacgatatccaaaaaggggtattacctgaagattttaccaaaaataaaaaagataaatccttctttctagctaacgctaatcaaattgttgacgcaattgatcaaatcgcgcaaaaagctgtagataaagggatttctaagaatgatattcaagttttagcaccgatgtatcgaggtagtgcaggagtagatgaaattaaccgacatctacaaaaagttttaaatccacctcaaacggataaaccgaagaaaatcgaatctggcaatcaaacttttagaattggtgataaagttttgcaattggttaattcacctgaaaataatatctttaatggtgatattggcgaaattaccggaatcgttatggaaaagcaaggcaaaggcagagctcatctagtcgttgactatgatggaaatgaagttacgtatgctaaaactgaccttggacaattgaccttggcatattgtatttcgattcataaatcacaaggtagtgaatttccggtggtgattatgcctatggtgcatcaatactatcgaatgttacaacgcaacctcttatatacagggctaactcgtgcgtccaattcgattattttgttgggtgaacctgatgcttaccaaagagcggtaagcaatgaatcatctaatcgaaataccagtttagaacgtcgaattaatccgcaagcagaagttttagctgaaaaagtaaaccaaatacaagtatcagaaccagttgatcaagagcaatcaacgtcagcaccagtggaagtagagcaaccaaagtatttaactacgtcgatggttcaaaaagaacaggtagatccaatgattggaatggaaggggtcaccccgtatgattttatttagttaatatcttgaagtgtgtagcctaagttgtctataatgataggtagataataattggaggttcagctgtggaagaaagtaaaacaaaaagaagaatgaaaatattctccttgaattcaaatcatgctttatctgaaaaaattgctgcagaggtgggaatgcctttaggaaaagctgctattaagcaatttagtgatggcgaaatccaagtaaatattgaagaaagtattcgcggggatgaagtttatgtaattcaatccatttcagaccctattaatgattcattgatggaattattaattatggttgatgctttgcgtcgtgctagtgctagccaaattaatgttgttattccatattatggatactctagacaggatcgcaaagctcgttcacgggaaccaattacagctaaattgattgctaatcttttggaagatgatgcaattactcgtgttctgacgcttgatttacatgctccacaaattcaaggatttttcgatgttccagttgaccatcttgccgctgctccattgttagcaagttattttagtgatgggagttttgatgtcgaaaatatggttgtagtttcacctgatcacgctagtgtttctagagctagaaccatggctgaattattaggtacacccattgcaattattgataatcgtaatgaagaatctgtggaaagtattaatgaaattccgactgaaatcattggaaatgttaaaaataaaattgctttggttgtcgatgatatgattgacacaggaacacgcttgacgatttcagcggaagccctccataacgcaggagcaactgaggtatatggtgctgcaactcatgcaatcttttctaataatgcacctaaaattttacaagaatccaaattgtctaaaatcattgttactgattcaattagaattgatgctgataagaaatttgataagttagttgaattatctgtagggccacttttaggaaatgcaattaagatgatttatgataatgaaccacttgctccattatttaaaagccaaaaataattaaataagtgttaaataactttttaaattttcgattaagatctgttgcagattataatttgtgcaggtctttttatttggaggaattcaatggatatattagttcaacaatggcataaaaaatctgttcaactttgggcaacgctagtagcgctaatattgataatatttttattaagagattttatgtcgcaaattttattggtagtaattttttcctttgtgtcacacgtgggaattcaaaagattagaaaatacaccaaggttagtcagccaattggtacaataattttttatattgttttactggcctttgcgggctttgttttttcttttacggcctcgatgatttacgatcaattaaaaggaattccttctttaattaaacatgctattgacagtgatacgtttagtaaccactatgttcaaacaatccttactgagataaatagaaactcacaagcggtgaaaggaagtcaatacatcgcaatgtctgggttaaatcagcttggcaggatcgggattgctgcggaacacgttataattgcgttatttctaagtatggtatttaatttaacttacaaccatttacgtgaatttgggcatgctattttaaagagtaagtatgatatcatgttcggaaatgtatactacttacttcgtaagtacgtagtgatactaggtacggtaattgaaacccaattagtaatttgtattatcaataccggtttgatggtgattggtttatggataattggggtgcctaaactactattaatggctattattgtctttgttctaggtttagtccccgttgctggagttttaatttcattaatccccttgtcaattgttgctttttcggccaatggtattatctcaattgcagaagtgctttgtttagtaatattgatacacttttttgaatcatactttctacacccaaggttgatggcgggtgccactgatttgccggtctttgtaaccttcattactttaattattggagcaaaaatgttgggaacttggggattgattgttggtattcctaccgtcgctttcttcattgatttattaggaattcaattaaagcagcatcatcctagaaaccctaaagaagttattgaaagtgaaattgaataatttagaagtcgtctatcaagtgataggcgtctttttttgatgtaaaatgaacgaaattgaatttttttgaattaatttgattgattttgaactaaaatgatggtatattcttctatggaggttgatgaaagtgcttacagaacttcgagaacgaaatattttacgtttattaagagagaaacaagttatcaaagttgatgaaattatgcatgcaaatcaatcatcaatttctacggttcgtcgagatttaaaaaaacttgaagcagaaggaaagctagtccgtgttcatggtggagctcaacttgaaaatgggcttcaaaccgaaacggattttcaagttaaatcgaagatgaatctattagaaaaaaatgaaattgggcgacaagctgcagaactggttcaaagtggggagattatttttctggatgccggaacttccacggcaacgatcattccatacttggcagaaatcgagggactgttagttgtaaccaatggattgacgattgctggattactgtcagattttgatatcaatgcgtatctagttggtggccaattaaaaaataaaacccgggctttgattggatcagaggtaacggatcggattcgaacatttcaatttgatcgatgtttcatgggaaccaatggggtatcccaagaattaggatttaccactccagatattcaagaagcccagattaagtcagaagtgattaaaagaagtcgaaatgcttatgttttagcagatagctctaagtttaataaggcttcatttgtacgttttgcagaattgcaagatgcaacaattattgccgaccattgtccagaatggctcaaagcagaggaaaatatatattatatggaggttcaaaaatgatttacacagttacacttaacccatcgattgattatgtaatcagtctggatgaaatgaaagttggcttggttaatcgcttgaagacatcaagtaaatttccgggtggaaaagggattaatgtttcaagaattttaaatgaattaaatgtgtctaacacagcgttaggttttctaggaggatttactgggaaatttgtgaatgatgcattaacaagattgaatgtgcaaaccgattttgttgagattaaagaagatactaggattaatgtaaaaattcatgctcaacaagaaacagaattaaatgctctcggacctaatattgatgatgcagaattagcaagttttatcgacaaatttaatcaaattggcaatggagatgttgttgtattttcaggaagtatcccagccaatttaccccagaacctttatgatcaaataattaaaaaaattaaggcaaatggggcgcaatttgcagtcgataccacgggacagggtctattagataccttagaaaataatccaatcgttattaagccaaataaccatgaacttggagaattatttcatacagaagtaaccaccgatgcagatattgagaagtatgctaaaaagttaattgaaatgggcgctcaaaatgtcatgatttcaatggctggtgaaggtgggatgctagtttccaaggatcgtgtgcttagaagttttgctccaaaaggcaaagtcttaaattctgtaggagctggggactcaatgttggctggatttgttggagaattcaatcagtcacatgatttagaaaaagcctttaaaaaaggtttagcgtgtggaagtgccacagcattttcactggatattgcaactaataaaaaaattgacgagatttttaacgaaattgatgtctttgaaaagtaaggggtaaaattatggagattaaagatttactcaagaaaaacttaatgattatggatctaaaagcagattcaaaatcggatgcgattaacgaaatgattgataaatacgttagtgaaggaattgttaccgatcgtgcgacctatcttaaaggtattctagatcgtgaagctgaatcaacaactggtatcggtgatgagattgcgatgcctcatgctaagactaatgctgttaatgaggcagcggtgttatttgctaaaagtagtaacggggtggattttgatgccttggatggaaaacctgtaaaattattcttcatgattgctgctccagagggggcgaataatgcgcatctacaggccttagctaaactatctagtttgctgattgacccagagttggtaggaaaattgaagaacgctgaaactccagcggatgtcttagcattatttgaagctgcagaagcagcaaaagatatagaagattcacatgatgctgaaacaactgaaccagtcgattcagataaaaagtcctttattgttgcggtttcagcttgtcctaatgggattgctcatacttatatggctgaggctgctttgaaaaaagcggctaaggaaaaaggaatcgagatcaaagttgaaacaaatggttccgaaggtgtaaagcatcgtttaactaatgaagatattgaacgagctgatggagttatcattacagcagataaaaaagttgaaatggcgcgtttcgatggcaaaccacttttaaatcgaccagtcattgatgggattaataaagctgatgaattaattgacttggttgaagctaatcaggctactacattccattctactggaaatgaagcgtcagaatctgaatcatcaaacggtggtttttggaatgaaatttataaagatttaatgaacggtatttctcatatgctaccatttgtagttggtggtgggattatcatggctctttcgttctttattgagcgatatacgtcagcaactagtttgtggtttactttccctaatggaattggtaattatgccttttcattcttgatcccaattcttgccggttttattgctcaatcaattggtgatttaccagcattaatgcctggggttgtgggtggttatatggcaacccagtcagctgcaagtgtaatgcatacaacaagtgtttcaggatttattggtggattaattgctggttttgcagctggtttaattgtcaacggtttgaaaaagttattcaaatttgttcctaagacacttgaaggtttaaaaccaatgttgatttatccaatcttgagtttacttttggttggcgcattaatgttctttgcagttaaccctgtgtttgcggccgttaatgcatgggtaactggtgtgctagaaggcatgggaaccggaaacgcggttctcttaggtgctgtactggcagcgatgatgtcaattgatatgggtggtccatttaataaggctgcttatgcgtttgcgattgcagcgtttacttcaactaaaaatggtgatttgatggctgctgtaatggtgggtgggatgattccacctttagctacagcaattgccacaacatgttggcctaagaaatttacggcacaagaacgtgaagctggaatttcaaactgggttctgggactatcatttattactgaaggtgccattccattcgcaactgctgatcctcttcgtgtaattggatcaagtattgttggttcagcaatcggtggtggactaagtcaactttggaaggttagtgttccggctcctcatggtggtatatgggtaattgcgttagctgatcataaattattctacgttctatctgtagtaattggtgcggtaatagccggtgtaattatgggattatggaaaccagtaaagaattcaaaaaatgcataaaaattcatttttatgtataaaaaatatggtttaacttgggagtattgttacattctttgtaacaatactctttttttgtaatattggtgtaacgttagataaacatgcatgaaataaaggattttaagaaaaaaagtgtcaaaagttatttgtttttttaagttttgttaaacattgtagtggcgggatttataagatttttttaatttatgatgaatagttaatgtataaaaagtgttttcaaaatatcttaaaaatgatagtattaaacatgtgcaaaaaaccaattctaatttattttgaatattaacgatagaaatcataaaaattatacgaaaatttaaggagtggacgaacttatatggttaccaattctaaatcaaatgcatccaaattattattagctggtgcggccggagcaggtcttcttgttgcaggcggaacacaagtgattgctcatgctgattctgtaaaggtacaaaagagtgatacagtttgggcactttcacaaaaatacggagtttccgttaaaagcattgaatcactaaataacattaatcaaaatagtcacttgatttttgttggacaagatatcaatattccaggcaaaacagactcaaaagttactaaaattaccgtaaagagcggtgatagtttatcagttcttgctgaaaaatatggtgtatctgttaatgccatcatgaaagcaaacaatcttagcagctcattaattattgttggacaaagtttaacaattcctgctgccaatggttcagcaagtcaagcttcaagtacatatgtacctcaagctactcaacaagttacagttcaagcaagtagtgcagctgctcaaactgtagtaacaccagcaccaagtagtgctgctacaacatatgtagcacctgcaagcagtgcagtaacatcacaagctgtaactagcgtagcaccaagttcagctgtatcatcagctgcaagctcagttgcaccatcaagtagcgcagtaacatcacaagctgtaactagcgtagcaccaagttcagctgtatcatcagctgcaagctcagttgcaccatcaagtagtgcagtgacatcacaagctgcaactagcgtagcaccaagttcagctgtatcatcagctgcaagctcagttgcaccatcaagtagtgcagtaacatcacaagctgcaactagcgtagcaccaagttcagctgtatcatcagctgcaagctcagttgcaccatcaagtagtgcagtgacatcacaagctgcaactagcgtagcaccaagttcagctgtatcatcagctgcaagctcagttgcaccatcaagtagtgcggtaacatcacaagctgtaactagtgtagcaccatcaagcgctgctacaactccttcatatgctacacatactagttcagctgcaacaactactaacacaaccaatgttgctagttcagctgcaacatcaagtgctgcaacaactactactcaaaatactggttctgttactggtttagctagatctttagctaataacacaatcccatacgtatggggtggtaaaacaacttcaggttttgattgttctggttttgtttcatatgtataccaacattcagttggtattagtcttccaagctatactgtagctatggaatcatatgtaacaaagaaatctgtttcagctgctcaaccaggtgatttattattctggggtagcgctggttcaacatatcacgtcgctatttatcttggtaacaaccaatatgcaaatgctccaacatttggtcaaaatgctaaggtttcaacaatttcatcatacttctacccaagttttgctggtagcgtacgttaaaattaactaaaaaataaacgtctcaattaacctaggttagttgagacgttttttattttaccttttaaaatttgggaaagggaacttttcatgtttagcaaaattatagctaaataaaaacgcaatcttttcaatcattagagatttatctcagagtttgataagattgcgttttttattaatccataattaacattggaataattacaggatgacgttcagtttgttcatataagaatttctgtagatcatcaataattgcccgattaatagaggcttcattagcgtgcggatttcgcattgcgtgacgaattctcgcaaacattcgacgccgaccttcattaattaattcaccggattctcgcatgtaaacaaatcctcgtgataaaagatctgggccggattcaatcatcttagtttttagattaattgttgcaacgacaaccacaagtccttcttcagaaagtaattgacgatcacgtaaaacaacgtttccgatgtctccaataccatttccatctacatatacatcaccggcactaaaatggccagaacgacgagcggagtcctttgtaagggctaaaacatcaccattggacataataaagctattttcgaatggtacatcacagtcatgagcaagttcagtatgcaattgcaacattctatattcgccatgaataggcataaaatatttaggttgcatcaaacgcaacattagacgttgttcatcttggccaccatgaccagaagtatggatgttattcacttttccgtgaattacgcgagcaccagcttcttctaattcgttaataactttattgacactgatagtattaccaggaattggattacttgaaaatacgacagtgtcatcaggttggattgaaatttgacgatgagtgccgttggcaattcgactaagcgctgccatcggttcgccttgagaaccagtacacatgatcaatactttattagctggtaaatggttaagttggtcggcattgattaatgcgtcatcgggaatatcaaggtatcctagttcacggccgttaactaaagctgcttccatcgagcgaccaaaaaccgcaattttacgaccatgttttagtgcagcttctgttgccatctggattcgagaaatgttagaagcgaaagtagcaaaaataattcgtccctcgacttcttcgaaaattttacgaatggacttaccaacccaacgttcagatttagtaaattcatcacgttcagcattagtactatcagacattaacaacaatacgccttcatcaccaagtttagccattttttgaaggttaggtggctgatgtgtagttggtgttaggtcaaacttaaaatcaccagtttcgacaatcaccccagaaggagtgtggacggcaactcctaaagtatctggaatcgagtgggtggttctaaagaagctaacgctagtcttagggaatttgattaccgtatcctcatcaatgatatggatttcggtggtttttaatagaccatgttcttcaagttttcctttaattaaagcggcagcaagtggactagcataaattggaacgttaatttgttgtagtaaaaacggaataccaccaatgtggtcttcatgaccatgtgtgataactaaggcttttattttttgttggttagcaactagaaattggtagtcagggataacgtagtcaattcccaataattcatcttcagggaatttgattccagcatcgacgacaataatttcgtcttgaaattgaataccataagtatttttaccaatttcattaaggccaccgattgcataaacggcagtctcgttatttttaatgttaattttacccataagcttagtactccactagcttgtaatttacaccttgttgttcatatacgagtgccttaccttcgagcaattcgacttgttcaacgttgaagtctggattgttagtttcgacgcgtttaattgcatctggcttcgtttcagcttcaataaatagtgagtgtgtattctcacgacgtggtgtttcttttttagattcttgataataaactttaaaaatcatgtttttttcttccttctttcgtaaaaatgtgttcaaataaaaataaaagttttgcccgttcaataagttgtattactacaacgcatctttaaacattttatcatagaggctgatataagtatagaaacatagccttgaaaggcggagggactggtatcaaaaatgctaattaagtcattaattataattttcttaattattttagttgcagtgctattaattcttacatatataaaaaggaaaagaattaccaaagcagctacaatagttagaaatgcaagtgaaacaatcgtaaataatgccatgatccaagtagctaagcagcttaaaatggatggtatggaatttgatggagcaaaaggaaaatcggtcgcagacgtttgggggcaatccgttgttggttttaattatcacgccaacctcaaacatagtatggatattaatttaattgaatctaaaattaacaaaattctagcggaatattgccgaaagcatcaattagaagacgaagatggtcctcaattaaaggtttcagatatttggcttaatcaaaaccatttagagttagacgttgtatatttaattaatcgtcagactaaagattacttaaatgatctcagtaagctataaaaaagaagctatgccacaaaggaatgaatagtcagaaattaagtagataacttaacttttgagattcaccatgcaggcatagcttcttttttataattagccaattaaaatagcattatcttcaatatctaaaggattttctttattgatatgatcatagaataaagtgccttttagatgatcaatttcatgttgacaaacaattgcaggatagtcgcggagtttaatagttttttcttcgccatccaaggtttggtaacgcacagtgatgcggtcgtgacgaggaacatatccaggaacgtctttatcgaccgaaagacagccttcgccttcctccaaagcagcaatttgaaccgattgactaacgattacaggattaactaatgtttcttctaaatcgatggtattatctggcccaggaacaaggactgaagccatttggattgataaaccaatctgtggagcggccaaaccaacgccggctcttaagtggtatttttcagcaatggctggatcttggctattttttaaatattccatcatttcatcggcaactttgagatatttaggatcaagcggaaaagtaagcttttcagcacgttttcgtaaaacgggatttccgtcacgagtgatatcgttcattttaatcaagataaaaacctccaattcgtctaacaacaagtataatatataatatagtattaacacaaaataaatcttaaaaggaatattaaaatgagtataaaagaaactttttcttacccaatcgatgaacgctggaatacagccgaattaactgatgtaattaatttcttcgctatagttgaaaaagcttatcaagaaggggttaaacgcgaaaaatttgttgaaagttatcgcaagtttcaagcagtagtacccaataagagtgaagaaaaaagactttttagggaatttttaagtaattctggtatggaaccatttttagcggttaaacaattaaaagatttaaatattaaaaaaattaaggtgattgaaaatgaaaaatatagataaagatttcttacttcaattagacgccaaaatagtggaatttctagtcaaagatcgtcaatttatctttgaaaagatgggaaagcatttggaagttgatgaaaaacaaaaccgccgagatttggtaactgaagtggatcgtggtaatcaagctcacattattgaagcgttaagtcaattactccctgatgctaaaattttagctgaggaatctgaaaatgatttaactgatgccaaggggttgatgtgggtcattgatccaattgatgggaccatgaattttgttaagcaacgtgaagattttgctgtaatgatcgctctatatgaagatggaaaacctttgttgggatatatttacgatgtcatgcgcgatgttttattacatggtggaccgggaattggagtggtatataaaaatcaagatgtaatcaatcctccagccaatctagctctagaagaaagtttaatcgggttaagtggcccaatgctagttaataatgcatatcacttccaagacgttgaaaaaagaacgctaggagctagagttattggcagtgcaggaatcgaatttattcgagtacttttgggtaaacaaattggatatgtttctagcttaaaaccatgggattttgctgctggaaacgctttagcagcggtctttgggttaaaagtagggtatgttgacggagaggctattaatgtgctaaaatcgggcgttgtactagttgctacgaaaaaagcatattctgctataatgagtatagtgaaatagcattatgctgtgacgaattagacgtcacaggtttttttatgttaagccattgaaaaacgaaagggagaaacatattgaatttaagagacgatattagaaatattgcaatcattgcccacgttgaccacggaaagactaccttggttaatgaattattgaaacaatcagatacattagacgaacacgttcaaattgaagaccgtgctttggactcaaatgcgattgaacgtgaacgtggaatcacaattctttcaaaaaacactgctgtacgttatgcagataaacaaattaacattttagatactccaggacatgctgacttcggtggtgaagttgaacgtatcatgcgcatggttgatggtgttttgcttgttgttgatgcttttgaaggaacaatgccccaaacacgctttgttttgaaaaaagctttggaacaacatttaacaccaatcgtggttgttaacaagattgaccgcccaggcgcacgtccagaagaagttgttgacgaagttcttgatctattcattgaacttggtgctgatgaagaccaacttgagttcccagttgtatatgcttcagctatcaatggaacttctagtttttcttcagacccagctgaccaagaacacacaatgaaaccaatttttgatacaattgtagatacaattccagctcctgaagattcttcagctgaaccacttcaattccaagttgctttacttgattacaacgacttcgttggacggattggtattggacgtgtattccgcggtcggatcaaggttggagacaacgtttccgtgcttaaacttgatggttcaaagaaaaacttccgagttactaagttgtttggttactttggtttgaaacgtttggaaatcaacgaagccaaagcaggggacttgattgctatctcaggtatggaagacattttcgttggtgaaacagttgccgatgcagaacatccagaagcattaccagtgttacgaattgacgaacctacactacaaatgacatttagaacaaatgattcaccatttgctggtcgcgaaggtaagttcgttacatcacgtcagttggaacaacgtttgaagactgaacttcatactgatgtttcacttcgagttgatgatactgatgatcctggtgcatggattgtttcaggtcgtggtgaacttcatctttcaattttaattgaaacacttcgtcgcgaaggttacgaacttcaagcatcacgtccagaagttatcatcaaggaaatcgatggcaagctatgtgaaccttatgaaatggttcaaattgatacacctgatgaatatactggttctgtaatcgattcactttcacaacgtaagggtgaaatgaagaatatggaaactactgataatggccaaactcgtttgactttcttggctccttcacgtggattgattggttactctacagaattcctatcaatgactcgtggatatggtattatgaaccatactttccaagaatacttaccacaaattaagaactggaatccaggtcgtcgtaatggtactttagtatcaattaattctggtaaagttaccacttacgctatcatggctgttcaagatcgtggagttatctttacagatgctggtactgaagtatatgaaggtatgattgttggtcaaaacagtcgtgaaaatgatatttcagttaacattactcgtggacgtaaccaaactaacgtgcgtgctgctggttctgaagatatcgctaaggttaaaacaccagttcatatgtcactcgaagaatcacttgaatttttgaatgaagatgaatactgtgaaattacacctgatcacattcgtttgcgtaagcaaatcttgaatacaaatgaacgtgaaaaagctgctaagaaacgtaaaatggctgctaaaaaataattaagaaaagacgaaaatttaattttcgtctttttttatttttaaggagcgtagtacgatataatagattaggtattatgcaggataagggtgaaatattaatgcaaaaatttttatattggtttccaaggcgatttaaagagcgattgccgtatctagatttatgggtaataatcccatatcttatacttagtatttttggaattgtaatggtctactcagccagtgctgatttttatatccagaatggaattagcgctaaaagttatctgttaaaacaagcagtttgggtaatggttggaattgtaatcatgatgttcttttttttgattaacaaaaaaggttttaggaataaaggtatattaaaaattggtgcattagttatgtacgcagcgtctttttttcttatattttttggttcgaatacaaacggagctactggatggatctatattggatcttttgggatccaaccggctgaatatttgaagttatttattattttgtatttatcaaatattttgtcactacatcaacatcggattgaattaggagaagaaatttcccctaaggtaacgtggagtccaatggttatgattggttcgctaattttattgaactttttacaacatgatttaggaggttcaacgattaatgcggcaattgcaattgtaattttgtttgcaggtggtaaaaattatcgtaaaagtgttgcgggaatatttgctggattagcagcattttttatactattaactacagttgcttcgaaaattgatgtgcatacctcaaattatatgcttcaacgtttggtaggatttgcgcatccttttgaactttctaaaggtgctggtaatcagttggttaattcatattacgcactcggtaatggtgggatttttggtgttggtttgggaaacagtattcaaaagaagggatatttacccgaagctaatactgattttattatgtcggtaattgctgaggaattgggtttgattatggttgtaattatcattttgatcctatttgtcattattttcagagcaattattcttggtactaggtccagtaaaatgtatgatgctcttgtttgttatggtattgcaacttatctagttgttcaaactttcttcaatgttggtggaataactggtttgataccaattacaggggttacgttccctttcattagttatggtggttcaagtatgatggttttatcggctaccatgggggtactactaaatataagtgcttcgcaaagacaagcacttaatgaacagaaacaaatcatagaggaagattagaatgaatatagtacaacgtcaaagtattattgtattttttaataacatcaaaaaaatcggacccatcaaaaaaattggcgatgttgattatgtttcaaaagatatgcattatttaatcctttacgttaataaaagtaatgttgaggaatctttaaaaaaaattcgaggatttgagatggtgagatctgcgtatatctctccacgatcagatttaagggttgactatagtcaagattattcagcagaggaagatgaacagtgagagttatttcaggtgattttggtggacgtcgtttgaaacccgtaccgggaatgaaaacccgtccgacaacagataaaattaaagaaaatatatttaatattattgggccatatttcgatggaggcttagtactagatatgtacgctggaagtggtggattatcaattgaagctgtttcgagagggatggatagtgctacgttgattgataaacaatttgctgctattaaaacaattaaagaaaatgttgaagtgactaaggcaaaggatcgttttgaagttattaagggcgattccaagaaaattattcaaatgttagctacaaaaggaaataaatattcgatggccttctttgatccaccttatgcactccaaacaattgagaaagaccttcaagaattaattggtttaaatttattaacttcagacgcaattatcatttgtgaagtcagtgatgaagttgaattgccagagaaaattggatatttaaatcgtgtacgtgaacaacattatggaattaccaaaattgtaatttataagggagaataatacgatgacaaaggctctttatgttggaagttttgacccgattactaatggccatctagatattattaaacgtgctgctaaaatttttgatgaattaacggtggtagtggcgattaacaccaacaaatcggctttatttacaccacaggaacgcgtgaacttaattacgcaagtgactagagaccttgaaaatgttgcttgtaaatctgtaacaggattaacggctgaaacttttacacaggaaaaagcagatgttttggttcgaggcgttcgcaatggggaagatttaaactttgaaattcaggtggctggaatgaatcaatatttaaatcaagaagttgagacggtatttataccagctaattctaagtgggaatttacctcgtctagtttaattaaagaagttgtaaaaatgggcggaagcattaaaggcctagtccctgaaactgtagaagtattattaaaatcaagactaaaatgactatttaaaggattggaaaataaattccaatctttttttgtatcttctgttagctaaggaggtgcaaaaatgttggaagaaatttgggaaaaatatcaaaaacaaattataataacaggtataacagtcacaatagtggtcatgtttttttgtattttggtaggagcggggcgtaatgatagtactgataagatgattggaaacaatctgactagttcgtccagttctatacaaagcagctcaaactctgcaacgccaatggcgagtggacaagataaggagactcacgcccagagacttgctagttctaaaataatggtggatgttaaaggagccgtgaaaagccctggagtttatgaagtaaagtcgggaatgcgaataatggatgcgattgaaattgctggtggaatgactaaatcagctgatcaaagaaatattaaccttgcgactcaattgtctgatcaacaagtagtttatgtaccgattaagggtgagataaaaaattctgatccgtcacaattaagtgcagttggttcatcgagtatttcaagtagcagcccttctacaaccgatagttcaactgaaaaaatagttaacataaatactgcctctaaagcagaattgttgacattgaatggtgtaggagataaaaaagctgaacaaattattaattatcgtgaacaacagggcgaatttaaatccattgaagatttaaagcaagtacaggggattggtgataaaatttttgaaggactacaagatgcaattactgtataaattaaggatggaaatgatatggacaatagaattgattgggatcaatattttatgacacaggcaaccctgttatcactcagaagtacgtgcacgcggctttcagtgggggcagttattgttagagaccggcgagtaatagctgggggctataatggttcagtttctggagacgtacattgtattgacgagggatgctatttagtagagggacactgcgttcgtacgatacacgcggaaatgaatgcggttctgcaatgtgctaagtttggtgttgcaacggatggtgcagaagtttatgtaacggattttccctgtttacagtgtacaaaaatgttgttacagtccggaattattaaaattaattatcttagaaattaccataatgaccaatatgccgtagagctcttaaaaagaaagaatgtcgaaattaagcagattaaattctcagaggatgatttagataaaattaatattaatcatattttaagagaaggtgaatgaggtttcttttatatgggcaacagtagctgtttttttactgtctggattaatctttaccagagctaaaatatttttattattattaataatttggttaattagaactatatgtttaaaaaaacttacagtggtaatgcaggcattattgattagtgtctgttttttcattcactttagtcataaagcaaattcaattaatacttataaccaaagtagaagtgatattgaaattgatttgagagtttatcccgatgaaattaagccaatggaagacggcgtttcaattcgagcatatactaacaatgttaaccgtaaaggcttgcaagtttttattccagttaaaacggtggacgatttaaaaaaaattagtaaaactcaaaaagtagttgaatttaaaattaaggggaatattgaaccgcttgaacgaccgacgaatataaatcaatttgattttcgacggattatgtatggtaaggcagtttattttaaagtgagtaaagctagtctgatagaatataatattttaactaaaaatagtttgattgctaagatacatagttggcgtaaaaaattattgaaaagatgtacaaagttagaggaaccactacagagttattgtatggggattatccttggggaacagacggattatctaaaagaaaatagcactaagttacgtaatatgggtattattcatttgttttgtatttcaggattacatgtgttttatttcatcaagttaattgaaattgtttttactagatttaaaattaaaagggaaacgatggagataacccaaataggagttttacccctctattttattttgggtgggggaagtactagcctatttcgcgcggtggtattagttttagttcagttgataactaaaaaaatagctataaaagttagtacgcttgatagctggtgcttagttttattagtcaatttatggcttaatccgtttgtcttacttcagatgggtgggcaacttagttatttattatcttttgtcttaattatgcaacaaatggaaaatagctggacaacaggaataaaattatttttggtagaattaccaattattctattttcaacatacaaaatccacttattaacgatggtttttaatttaattattgttccgattttttcgagtgtaatcgttccaatcgtaattgtagcttttgcaattccccaattaatggtgctattaaatccaattattatgatgttcgaagtaactttgaaatatttagataaattaccgggattaattcaagtaggtaaaccttcgcggctgatcactttattcatggtgatattagcgctaaaaattatttcaacaaagcaaagtaaatttaagaaaagagcgttaacgttctatagtctgatttggctggggttgtggagttggtttaaattgaacccgtatggtgaaatcaccttttttgatgtaggtcaaggcgatagcattttaattcgtgaaccgtttaatcgaacagtaacgttaattgatacaggcggtaaaatgcaatttggcaaaaagccggttgcaatgaagcataccatcgctaagaatagttcaattaattatttacaaagtataggagtatctaagttaaataatttatgtttgacgcatcaagatgttgatcatattggagaagccagtgaaattttaaacaattttaaagtgaaaaatttggtttttccggtgggggttgatacaactcaaaattatcaacgaaaaatattgccatttatccgatgcaatacaaaggtgattgcgtgcttagcggggacgaaaattgatcacttaccaatggaaattaagtatccgtttcaagctggaaagggtgaaaatggtgattctttagttttagctggtaatgtgggtggtaaaaatttactactaacaggtgatctagacctagctggtgaacgtaaattgttagaaagtggtgtattaaatcaacgggtggatatttttaaattagggcaccatgggagtaagacggctaattctgaagaaattctaaaagtaattatgcctaaattagctattgtttcagctgggcgtcataatcggtatggacatccaaatctagaagttataaatcgcttgaattcaatggggattccttacgcttcgacacaggatgaaggaatgatttcttatagatattttttgaatggtatgggaagatggaagacaggaatagatgaaaaggaaagtattattcaatgaaattaactgatttaagaaaaaaacttaaacaagggcaattgaagtcaatctatttggttgaaggtcctgataactatatccagaaagcggtcaaaaaagaattaattgatttcattcctgaagatcaaagggtaatgaacgtaggaacgtatgaccttgaaaatgtggacttagggatggtcttagatgatgcacagtctgcccctttttttggcgattatcgtttggtcattttaaataaccctgtattcttgactggtgaaaaaactaaattaaagtttaacttggacgggttgcttagctatattaaaaatccggaacctactacaattatgttaatcgctgcaaaatatgaaaaactcgatggtcggaaaaaaattgtcaaagacttaaaaaagattgtagaagttatcgatgctaattcaccgaaagaaagcgatactcggaagattatccagcaatacgttgatgagaaacgaacagaaattgacagtgatgcgttagatgaattaattttaaggacggataatgatttagcacaaattattaatgaattacagaaattaactgtatatgcatcgggaacagagaaaattgatttgaatgccgttcaaaaattagttcctaagagcttaaaccaaaatgtttttgacttaatcaatgtattaatgcaaggaaatttacgtaaatcaatcgatgattattctgtattactcctaaatcaagaacagccactaaggataaacgcggctttggttagccaatttcgattgttgctgcaagttaaaatattgatggagagaggtttctcacaaggaaagctagcacaagagttaaaggcgcatccttaccgaattaagttagcaatgcaatctgtgcgtcagtttaatattcaaagtctcgaaaatgcttatatggggttggttgatttagaagaacaattaaaaacaacccaacgagatccgaaggaactctttgagttgttcttagttaaatttaaaaatggatggaaataaaaaacaccggaaatccggtgtttttttatttgctaagcattttagctaaacgtgacttcttacggccggcgttgttagctttaattaaaccttttgacttagctcggtcgatacgactgtaagctgtttgtaaaagttcattagcgttttcagcgttgtttgtagcagcaatttcgaatgctttgatgcttgtacgcattgcactcatttgtgagcggttgcgagcagcagctttttcacttgtgcgaacgcgtttcattgcagatttgataactggcattttattcacctccagaatatggttagtacaacaatattattatacagatgacccgtaattattgcaatgcttgaatgcacttgaaaattttcattatattagttaaactagatactgcttgataatagcaaacccattacttagtccatcgatctgccgacgatttactcagtcttggggaatttaaagaatgaggtgttttaacatggcaatttcacaagaaaagaaaaacgaaattattgcaaagtatgctcgtcacgaaggcgatactggttctgctgaagtccaaatcgcagttttgacagctgatattaacgaaatcaacgaacatttacgtgttcatcgtaaagatttccattcacaacgtggattgatgaagaaaattggtcatcgtcgtaaccttcttgcttacttacgtaagacagatgtacaacgttaccgtgatttaatcaagagtcttggtcttcgtcgttaatattatatttttttgcctcctgttaattcaggaggcttttttgtttttggcgtttaatctatgctagaattaaggaagtatgtattgtgcggaaaataaaaaattaatttatgtaggtgaaaaaatgagtgacacaataaaaataattccatttggcggtgttcgcgaaaatggaaagaatatgtatgctgttcaaattcatgatgatatttatatcttggattgtggactaaaatacccggaaaatgaattgctgggtattgatattgtaatcccagatatttcatatttggttgaaaacaaagaaaaaattgtgggtgtgttcctaactcacgggcatgctgacgcgattggtgctttgccatatttcttaaaagaaattaatgtaccggtttttggttcagaaatgaccattgccttggctaaaattacggttaatgatgaccctgaacttaaagcattcgataatttccatgtggtagatgacaagaaagaaatttattttggcgacgttactgtttcgtttttcaagactacgcatacaattcctgaatcacttggaattgtgttgagttgtacggaaggacaaattgtatatactggtgattttaaatttgatcaaacggctactgatggatatcagacagatttcggacggctagcacaaattggaagtaaaaaagttatcgcgcttttaagtgattctgctaacgccgaaaatccagaacgttcatctaatgaaactgatattgctgatgtaatggctgagacaattaaataccatgaaggtcgggtaattgtagcttcagtggcttcgaatattttacggattcaacaggtgattgacgctgcagctaaatcagataaaaaagtcgttttaacgggacatgatttagagaagattgttaacacagctatcgagttaaataaattaaacattccagatgacgaattaattgttcctttaaaccaactagataagttgaaaccagaagaaacgattattttggaaactggtaaattgggtgaacccatcaaagccttacaaaaaatggccgctagaaaaaagggaaatcttaagattcaaccaggtgatttggtagtaatagctactaatccttcccatgcgatggaaacaacgtttgctaagactaaagatatgttgtatcgtgctggagccgaagttaagtcgatttcagaccgagctaatgctacaggtcatgctagcaaagatgatttacagttaatgcttaatctaattaagccagaatttctaattccgattcaaggcgaataccgtcttttagtagctcataaagaacttgcagaacaagttggtctcaatgaaaatcaaattttcattgcttcaaagggtgatgttttagaatataaagatggtgaaatgttcctaggtaaaggaattacggtcggaaatacaatgattgatgggattggtgtaggggacatcggtaacattgttcttcgagatcgtaaaattttatctgaagatggggttttcattgcggtagtgacaattgaccgtaagaagaaaatcattattaaagaacctaaaattacgtctagagggtttgtttacgctaaaacaagtgtagatttaattcaagaaagttcggacttggttgaacgagcagtacaagctaatctcgataataaagaattcgattggggacatttgaagcaagatgtacgtgaccaattaggtaaattcttatacgataaaacgaaacgacgtccagtaattttaccagtaattatggaagtgaaccaacatcataagaagagcaaaaaatcgaataaatctaaagacgatgaataatatgaatgtaattagcaaagcaaatgaagcttggaaaacaggtcaacgtgcagaagctattcatattcttgaaactgagaatgaattaaaacaagatgatgaattaatccgtgttttaattcatttttacgttgaaaataaacaatttaaggcagcgattgagttgattcgtgatcaaccagctaagttcattgagcagaaaaatacttttagagattattttgaggcgctggttcaaacaaaaatttttagtttagctcgaaaagaactttttaactattatgaagagactacgccagatttaaagaaatatttaaattttctcgagaatcaagaaaatgaatatgcgattgcttttcctaaaactgtgaaagaaaacgaacgagatttttaccatctaggtgataagagggttattcagcaagctgctgtaattgaaaaagcttactatttaccatggagtaactttaaacgggcggcaaagtttaatttagttgatccgtttttaaaccaaataacgcgtgtttcaattttaaaagacttggttttgatgagattagaggaaccagtgcgctttatttggattgatgaaaaagaatatgaagtgtttccaaaggacttattaggaactgatgagatgtggaaaaaaataaaaaaagctattgaaaactataatgatccagttcaatcagaaatgctacagcagcaagctgaattgctatatgagctttcctatcctttttcaaagcgtgtcctacctacctcagaagaatggcttacagcgctaaagaaacagttttttgaggggaaagatataaaagcgttcaaagaattgaatcaaatcatgattaacttatttgaagagtaagaaaaaaatcgaattaataaaatattttagtttacaaaataaactcgattattatacaatactagaggattctctgacggtgctttgcctttcgtggaggatgtagtataatattttttaaaggatctagttattcattttgaatgctgagtgattcttacgacatacaggaggttcgtattaatggcaaaagaacattacgaaagaacaaaaccccatgtaaatattggtacaattggccacgttgaccatgggaaaactactttgacagctgctattacaaaagtgttgtcagaaaaaggactagctaaagcttcagattacgctgatattgatgctgctccagaagaaaaggaacgtggtatcacaatcaacacagcccacgttgaatatgaaacagaaaagcgtcattacgctcatatcgatgctccaggacatgctgattacgttaagaacatgatcactggtgctgcacaaatggatggtgctatcttagttgttgctgcaactgatggtcctatgccacaaacacgtgaacatatccttcttgctcaccaagttggtgttgactacatcgttgtcttcttaaacaagactgatcttgttgatgatgatgaattagttgaccttgttgagatggaagttcgtgaacttctatctgaatatgatttccctggtgacgatgttcctgtacttcgcggttcagctttgaaagctcttgaaggcgatgcagaacaagaaaaagttatcatggatcttatggatacaatcgacgaatacattccaacaccagaacgttctacagacaagccattcttgatgcctgttgaagacgtatttacaattactggtcgtggtactgttgcttctggtcgtatcgatcgtggtgaaatcaaagtcggtgacgaagttgaaatcgttggtcttaaagaagacgtaacaaagacaactgttacaggaattgaaatgttccgtaagactcttgatgttggtgaagctggtgataacattggtgcacttctacgtggtgttaaccgtgaagatgttgtccgtggacaagttttggctgctcctggctcaatccaaacacacaagaagttcaagggtgaagtttatatcctttctaaggatgaaggtggacgtcatactccattcttctcaaactaccgtcctcaattctacttccatacaactgatgtaacaggtgttattgaattacctgacaacgttgaaatggttatgcctggtgataacgttacatttactgtagaacttatcgaaccagttgctattgaaaaaggtactaagttcactgttcgtgaaggtggacacactgttggtgctggtgttgtatcagaaatcgacgactaagcttaattgcttaataaaaacccgcttttgcgggtttttttgttgtatttttatttacttttcaaaccatatacgttaagattataagcgtatgcaatccagaattgtaatgaaataaatcatctgtcggagggaacacaatgactgcaaaatgggaaaaaacaggtactaacgaaggtaaattaactttcgaagtaggtactgacaaaattaaagaaggcgttgataaggcgttcgatcgtactaaaaaacaattgaacgtacctggattccgtaagggacacgttccacgccaaatcttcaataagatgtatggtgaagaagcattgtaccaagatgctttgaacatcgtgttaccagaggcttatgaagctgctatcaaagaagctggtattgaaccagttgatcaaccacaagttgatgttgaaagcatggaaaaaggcgaagcttgggtcctaagtgcaattgttacagttaagccagaagttaagcttggcgaatacaaaggcgttaaagttatcaagcaaagcacacgtgtaacttcaaaagaagttgacgaagaaattgaaaagaaacgtgaacaacaagctgaattagttcttaaggaaggcaaaccagcagaaaacggcgatacagtaacaatcgattttgatggttctgttgatggcgttgcttttgatggcggtaaagctgacaattacgaccttgtattaggttcaaactcattcattccaggatttgaagatcaattgattggtcataatactgatgaagatgtagatgttaacgttacattccctgacgactaccaagctgaagacttacaaggtaaggatgccttgtttaaggttaagattcatgaaatcaagactaaggaattacctgaacttgatgatgaattcgctaaggatgttgacgaagatgttgattctcttgaagatttaaaagttaagacaaaagaagaaattaaatcacgtaagatccaagctgctagtgatgctaaagagacagaagctgttcaagctgctgttgacaatgctgaaattgcagaaattccagaagcaatgttaaatgaagatgttgatcgtcaagttaaccaatatcttgcaaacatgcaacaacaaggaattagccctgaaatgtacttccaattaactggttcatcagaagaccaattacgtgaccaattacgtgaaggtgctgaaaaccgtgttaagacaactcttgttttagaagcaatcgttgaagctgaaaagattgatccttcagatgacgaagttgctgctgaaatcaaagatttagcagaacaatacggcatggaagaaaaagctgttcgctcagctctttcagaagatatgatcaagcatgatgttgctattaaatcagctgttgaacttatcaaagactcagcaattgaagaaccaaaatcaaaggctgctaaaaaataattaaaactatttttaacgattttgaggttttatctcaaaatcgtttttgtttattaaccactaaagttatagaaattggcttatagtcgtttattttgctatgatgatagtggtaaaaatcatttgagaggtgacagaattgtttgatgatcaacaaacgaatgaaccagttacttgttctttttgtggtaagacccaagatcaagtaaagaaaattattgctggcccagatgtttatatttgtaacgaatgtgttgatctttgcaaggaaatcattgatgaagagttggcttcagaaaacgtaccaactgaaatcacggatgttccaactcctgcagagattgtagattatcttaaccaatatgttattggacaagaagaagctaaaaagacattatcggttgctgtatataatcattacaaacgaatcaataaaatggctgaaactaaagctgacgaagatgaaccagaactccagaaaagtaatattagtttaattggacctactggttcaggaaaaactttcttggctcaaagtttggctaaaattttaaatgtaccttttgcgattgccgatgcaaccacattgacggaagcagggtatgttggtgaagatgtcgaaaatattctacttaagttattgcaaaatgcggactacaatgttgaagctgcagaacgtggaataatttacattgatgaaattgataaaatcgctaagaaaagcgaaaatgtgtcaattactcgtgatgtttccggtgaaggtgtgcaacaagcccttttaaaaatcctagaaggaacgattgctaatgttccacctcaaggaggaagaaaacatccacaacaagagtttatccaaattaatacgacgaacatcttattcattgttggtggtgctttcgatggcatcgagacaattgttaaaaatcgtttaggtgataagaccattggctttggtacaaatgcaagtaccactgttgaagaagataagagtttgatgcaacaagttattccagaagatttgcttaactttggtttaatcccagaatttattggacgtttaccaattctttcagcgttggaaaaactaactgaggaagatcttgttcatatcttaacagagcctaagaatgcgttagttaagcaatataagacgttattaggtctagatggcgtagaacttaaatttacaccacaggccttgcatgcgattgctaaccaagctattagtcgtaatactggtgctcgtgggttaagatcaattattgaaaatgtcatgcgagatatcatgtttgaaattccttctcgcaatgatgttgcaaaagttacggtaaataaaaagactgttattgaaggtgcggaacctgaagttgagttaatcgacgaacaagcatcgtagtctaagttttaagaatcaggctataagttcctttagtctggttctttttttgttgatccatgttatcattaaaagcagaaattggaaggtggagaagtaatggaagtccataatgtagaattacagattagtgcagtgagacccgatcaatatccagaacaaggttatcctgagattgctttggtaggacgctctaacgtcgggaaatcgtctctaactaatacgttaattaaccgtaaatcatatgcaaggacatcatctcaaccaggtaaaacacaaactttaaatttttaccgggttgaagatcaattattctttgttgatgtcccaggctatggttatgcaaaagtttctcagaaagaacgtgaaaaatgggggaagatgattgaaaagtatatcacctcccgtaaagagcttaaaggcgtaatttcactggttgatgcacgccatgaaccaactgacgatgatatcaccatgtatcaatatctacgttattatgatattcccgttctagtcgttgctactaagagtgataagattgctcgaggaaaatggaatcaacacgaaagtaaaattaaaaaggcactagattttgatggaagtagtgctttccaaatgttctctgctcaaactaaaatgggaaaagaagaagtttggaaatggattgaagataggatgggagaatagcatggaatttaatgaataccaacgtactgcaaataaaaccctatttggcaatgaacaagttttaacgaattgtgctttaggactagccggagaaagcggacaggttgtgaatttagttaaaaactatacgttccgtggagctgatcttgataaagaacaacttaccaaagaaatgggcgatgttctatggtatctttctcaagttgctgaatgggctgatattcctttcgatgaggtggccaaacaaaatattgccacacttgaaaagcgttatcccggcaactttaagtaaataaaaaaccacaattaacagcattaatgctgttaattgtggtttatttttttgaatcttttttattagtacctttagcaagaaatttatttttcttttctttttcctctacggaagttttagtttgagttgttaattgatcgaacattttttcgagattatcatttcttttaacagtgagtcccatttctaatcacctctttccgaccataataccaaaaaaaatttcatttgtcagaaaataaaaattattcatatttatagtgaatattatatattttaatgtataaaaattcatattttaaataaaattcttttatatcaaagggtatagatgtatattagtaacattatattgaataaaggatgatggcgatgaaaaaaatatataaatttatcatgttagcgttattagctataacagtttttgcaacttcgggttttacaactagtattaaggcagatcaaaaggatgttacttatgatcggattatgaagcgcggttatattgtacttggtaccagtccagattatgccccgtacgaatttcaaacaacatctaataataagagtaaagatgtgggaatggatattagtgtggctaaggacattgctgatgatttgggtgtaaaattgaagatcaaaaatatggattttgattctttattagttgcactacaaaccggtaaggttgacatggttctttccgggatgaatcctagtgctgctcggcgtaaatcagttgatttttcagatgtttactataaaggtggacaaagcattctaattaataaaaaggatgcaggtatttataaaaataaagattcttttaaacataaaaagattgcagctcaaactggctcaattcagtacaatttagccaaaaaacaaattgatggagccaaagtgagtggtattcaaaaaggggcagatttaattctagctcttcaaactaataaagttgaaggggttgtcatggaaaaacctactgctgaagcatatgctgctaataatagtggtattaaagttatccaaggcggattcacgttaaatgatgatgaaactagcacagcggttgcaatgcctaaaaattcgccagtcctgagaaagaaaataaatactacaattagtaagataaaagctaaaaatttattaccacaatatcttaaagaagcagggacgtatttaaaaggaaacaccgttaatacctctatgattcattattggaagtactttgccatgggagtgggttatacaatccttatttcaattttgggggttatttttggttttatcaccggaacattactagcattactacgcttgagtgacaataaagttttacgtggtttatcagcagcgtatgttgaatttgtacgtggaacgccgttgatggttcaattgatgttcgtttactttggacttggattatttgttaatttaccagcccttaccgcaggaattatcgctgtatctttaaatagtggagcttatgttgccgaagtaatccgtgggggcattaattccgttgatgatggacaacgtgaagcagctgaaagtctaggtttgaataagcgagatcggatgcgttttgtaattatgcctcaagctttaaagaatatttggccagctttggggaatgaatttatttctctaattaaggaaagttcaatcgtttcaattattggtgtaaccgacttaatttaccaattaaagattgttcaatcagatacttatcgaggggtagctccaatcgttgttgcgatgattttatactttgtaatgaccttctcactatcacgtttacttaagttctatgaaaggaagtttaacaatggctaaagaaatcatcaaaattgaaaatttgaccaaaaaatatggaaaaaatacaatattaaaggatatttcagcagaagtgaaggatggagacatcattagtgtcattggtccttcaggagctggtaaaagtacatttcttcgatgcttaacacttctagaaaaacctacggcaggggtggtttcgttagaaggtgaagatttaactaaaaaaactcaaaaggaaattgaacatgttcgtgaaaaagtcggcatggtctttcagaattttaatttatttccgaatatgaccgttcttaaaaatattaccttagctcccatccgagttaagggattaagtgaagcaaaagccaatcaacaagcccttagtctgttggaccaagtcggattatcagataaggcggaggcctatccagataatctatctgggggacaaagacagcgggtggcgattgctagggcattagcaatgaaaccagatgttatgctttttgatgaaccgacttctgcgttagatcctgaaatggttggagaggtactgggtgttatgcgtcaattagctaaatcagggatgacaatggttgtggtaactcatgaaatggtatttgcccagtcagtttccaatcaaatttggtttatggaaaatgcaggtattcaagaaaaatcaactccagaagaattttttagcaatcctaagacggatcgggccaaggaattcttatctaaaattttagtcaaataggaaaagcaggtagagtgtaatactactacctgttttttcgttttagttgctgaatatggtaaaaacagagtataatgttatgagttattatgtaaactaggaggggtcaaattggcatcagaacacattgaacataagttggcattgttaccagataaaccaggctgttaccagatgaaaaatcttaatagccaaattatttacgttggaaaagccaaaaacttgaaaaaccgtgttcgctcttactttaaaagtagccatgagggaaaaacggcgaaactagtgagtgaaatagccgattttgactatattgttacctctagcgataaagaagcttttttactagaaattactttaattcaaaagttccaaccttattacaatataaaattgaaaaaagggactggctatccttatattaaaattacgaatgaaaaagatccacgaatggaaattgtttcaagtgttcgtcgagatgggggcttttactttggaccttatccaaacgtgtatgctgctgaagaaacactccattttttggaaaaggtttatccactacgccgatgcaatggatttcaaggtcgtccttgcttgtactatcatatggggcaatgcttgggagcttgtttccaagaggtacctaaagaagaatacgaccaacaaatcgctaaaattaaatcatttttacgaggaaatgtcgcaaagattaagcagtcccttcaaacaaaaatgcaaaaagcttctgaagcaatggaatttgaacgggcagccgacatacgagatcaaattcattatattgaagtaacggttgagaagcagaagattatttcaaatgatagcacgccacgtgatttgtttaatttctatcttgataaggggtggctttctattcaaatcttctttatccggcaatcacgcttgattaaacgagagaagagactatttccaatcgcaacagatgtgagtgatgagctttcgtcttttattcttcaattttataataataaaaataaggttttgccaaatgaaattttagtaccgagtggcttagataataaaattatggccgaaattttaggtatcccagttcgcactccacagcgtggagaaaagaaaaacttgttagagttagctaaagaaaatgcacaaattactcttgaggaaaagttccgattaatggagttagatgaaagtaaaacaacaggcgcaatgaaggaaattactgatgcgcttggaatccccgaaggtcatcggattgaagcctttgaccattctcatatccaaggttctgaattagtttcagcaatggttgtttttacggatggaaagccagataaaaagatgtatcgcaaatttaagctaaatacggtcgatcatgctgatgaagctgccagtacgagagaggtaattcgtcgccgatatgttagactattaaaagagaaacaatctttgcctgatttgattttaatggacggtggcgatattcagcttaatgcagcaaaggatgttttggtaaatgaattaagtttgcatattccagttgctgggatggttaaaaatgatagacataaaacttcggatttgatttttggtagccaagaccaacgagtacagttggatcctaaaagtcagggcttttatttagttcaaagaatccaagatgaagtgcatcgttttgcgattactttccatcgtcagttgcacgccaaaaattcgttggcttcccaattagatttaattcaaggtgttggacctaaaacgcggaacaagctgttgaagtcgtttggttcattgaataaaattagggatgctaatttgaaagaaattgaagaactcggaattccagaaaaagtagctaaaactatcaaagtgtccttatcagtgcacggaaaatagggtacactaacaaatggataggaatttctcggtgaaataaaatatttaggagaaaataatgtttgtagatcaagttaaaattaatgttaaagctggtaacggtgggaatgggattgtagctttccgtcgtgaaaaatatgttcccaacggtggaccagctggtggcgatggaggccgtggtggtaacgtcgtcttaaaagttgacccaggtcttagaaccttgatggatttcaggtatcgtcataagttcaaggcggattctgggaaaaatgggatgaataaacaaatgacgggacgtagttctcaagatctcgtgatttccgtaccaggtggaacgattgtccgcgatttaaccacaggacgtgtaattggtgatttaaccgataacgggcaagaattagtggtggctaaaggtggtcgtggaggccgtggaaatatgcgttttgctagccctcgaaatcctgctcccgaaatttctgaaaatggggaacctggagaagaaattgaattacaattagaacttaaggttttagcggatgttggattattaggatttccatctgtcggtaaatcaacactactttcagtagtaacgagtgcgaagcctaaaattgcggaatatcattttacgaccttagtacctaacttagggatggtccaattggatgatggtcgtgattttgttattgctgacattcctggtttgattgaaggagcttctcaaggtgtgggattaggttttgaattcctacgtcacgttgaacgaacacgggtcttacttcatttagtagacatgagtggaatgacggaagaagatccattcactaatttccgtcaaatcaatgaagagctaaaaaaatataatcctgaattgttggaacgtcggcaaattattgttccgactaaaatggatttacctggatccgatgaagagcttaagaaatttgaaaaacaagttcgagctgatgaacgttatgctgattttgaaattttcccaatttcttctatcacccataatggacttgaaaaactagttgctcgaactgcagatgtattggaagaaattccacagcattcattaattgctacttctgacgaagaaactgaaaagacatatgaatttagttcagaaaaagactttatcattgaaaatattgatgacgtttgggttattgagggtgaaaagattgaaaaactctttaagatgactgatacaacgcatgatgaaagtcttttacgctttgctcgtcaaatgcgtggcatgggaattgatgatgaattacgtcgcttaggtgcacgtaatggagatagtgttcaaattttggactttgtatttgaatttgtagaataaaaattattaaagtcagtggtaagtacagaaaggaatgtttaatcttaaacaattctgttctcatcactgactttttacttgattactagatattgatcacgtagataatatccaaatgtatgagtttttagtttggtttcggggttgaacaataatattttagcttctcttggtgcttcaatagttttggttcgaaattgactaaggggaaactgatgaggatttaaagttaatgtaagcaatatttctttttgaagggtattaacgatgatccctgaaacaaaaaataattgttcttgatcccccttaagaattaagtgggaacgtaattcggccgttgattttatgaaattatttaaattcaaaaagaaacctccttatttaataatacttatatagcaaggatatcttagaattatagtcgatgctagtgatacaattaaaagtattgtaaaatggattgttaagtcaatagatataggtgaaaatatgcaacttgaatttttaggaactggagccggaagtcccggtaaattccgtaatgttactagtgtagcattaaaattattagatgaaagtaatgaagtttggctttttgactgtggtgaagcaacccagcatcaaatcttaaaaactaatataaaaccccgtaaaattgataaaatatttattacccatcttcatggtgatcatatttttggtttgccaggtttcttaagtagtcgttctaatcagggtggtagcgaagaacttaccatcttcgggccaactggcattaaagactttgtgatgacctcattgcgcatttcagagtcaaaactttcatatcgaataaaatttgttgaaatagctcaagagggcgttttatttgaagatcaaaattatattgttaacgttgctgagttagatcatcgaattaaaagttacggttttcgggtaaaggaaaaagaccattcaggtgaacttttagtcgataagctaaaagaattagcgataccttcaggacctatttatggtcagattaagcaaggtaaagaagttactttagatgacggtagagttattaacgggcaagatttcattggaaaacctcaaccaggtcgagtagtcacagttttgggcgacacacgacaaacgcctaatatcgaacttttagctaaagatgcggatgccttggtccacgaaagtacttttggaaaacaagagggaagcttggcacgtaattattatcattcaactaatattcaagctgcgaaaattgctaagcaagctaatgctcggcaattattgctaacccatatttcagctcgttatacgggaaagctcagtaagcaacttgaaagtgatgcaaaggaaatttttagtaatagtaaagttgttcgtgattttgacataattgatattccattaccttaaaagtaggagtgattttaatgacaacggcagtaattactggagcaggcagcggtttagggcaaaagattgcgattttgaatagcactcactatgataatttagttttaattggaagaaattcagaaaagttaaatgcaacggctgaaaaatgtattgttaaaggtgaaaatagaatattctgtttggcatgtgatttaacgaaagaggaccagatccgtcaaacgggagcatggattgattcacaccttggaacagtcgatttattagttaataacgctgggctaggatattttgaaaacttattaaatcaaagctttgaacaaattgaacgaacgtttgcaacagacttgacggggatgattaagttcacacgcttaatgttgccattaatggtggatcacgttggagaagctgcagatattgttaatattgcttctattgctggtaaaattgcgacggctaaaacaactacgtacgctagtgctaaattcggcgtgatcggcttttctaacgcccttcgtctagaaatgtatgaccgcaacatccgtgtccacacaattaacccaggaccaatggatactaatttctttagtattgctgatcctagtggtaaatatttaaaaggtgttcaacaattcgtgattaacgcgaatcaagtggctgaattggtgaataaggccattattgaaaatcttagggaagttaatgtacctaaaataatgggagtgggagcgattatgtacaccttatttcctaaaatgggtgatttaatcgttaatagtcccttgattaatcgaaagtagttggagttaattaatgaaagataatagatttaattggcaagttagcaagttagatgatgttgatatcgatcaactggcatcggaaaccaaacttagccagacgatggttaaaatcatggtcgctagaggttttaaaacaggcgaggatattctcagttttattgatgaggatatgtcgattgtacatgatccgatgctactgcacgatatgcaaaaagcccttgaccgaatttttgtggcgattgaaagcaacgaaaaaattcttgtatacggtgattatgatgcagatggggttacaagtacgaccattatgtatgaaacgttagatcagttaggggctaacgtgcaatactttgttccagaccgttttaaggatggttatggtcctaatttgaaggagtaccaacacttcattaatgatgaaggggttcagttaatcattaccgtggataatggagttgccggaaatgaagcaatcaaatttgctgaagatcagggtacgaatgttattgtcacggatcatcatgaaataccagaagtattaccggaggcatatgcaattatccatccacgtcacccagagggagcctatccatttggtgatttgtctggagtcggggtagcttttaaggtggcaacagctttacttgaagaaattcccgaagaattccttgacttgtatgcaattggaacgaccgctgatttggtttcaatgaccgatgaaaatcgttttttggtaaagatgggattagaaatgataccaaacacccagagaattggcttacagaagttaatcgaaatatcaggtgttgatgtaagtcatttcgacgagcaagacattggttttactgtggctccgagaattaatgctgttggtagattagaaaatgccagccgagcagtagaattgttaacaacttttgatgaagaagaagccacaacaattgcacaagagattaataagattaattcgaagcgtcagggattagttagtgatatttacactgaagctgaagaaattgtccttgatgatgagcatgctagccgccaaacgctagttattgctggacacgactggcatcaaggagtcttggggattgttgctagtcgaattgtcgaacgaactaataaaccgacgattgttcttagtgatcaaggtggtaatggaatttataaggggtctggacgtagtgttgcagctctaaatttatttgaagctattaatcctatccgagaacagtgtattgggttcggtggacatcatatggctattggggttaccgtagaggctgaccagcttgcaactctaactgaccagttagaaaaggcgggtcaattagctaatttagattttaagcaacagccgcaattacaaattgatttaaaagtaaatattgaagaattaactgaaaagttagtttcagaaatgaaaattttaggaccgtttgggatgaataacccagtaccgaagtttgaacttgaagacgttcgtgttaaagaagcaaaggcaattggtaaagatggggcacatttaaagttcacgcttgatgatggtaatcaaaatatcaatgccattgcgtttaaacggggtgagttagctgatgtcttaaataatgttgcaaatcccattagtttggtgggaaccatcaatactaacgagtggcgtggtaatgtttcggttcaatttatgacggatgatatcaagatcgatggtttgcaagttattgatcaacgaacctcaaatttgaataaaaacttatttaagagtgacatgcaatatgtcttttttaaccaaaagttaatggatttgattcaaagtcaaaatcttaatcgtaaattctattattacagttcgtcagcaattgagaaaaatgacacgattgtattagtagattgtcctgataatctagccgaaatggccgaacttatcaaggctacgcagccacaaagaatcattacttatttctttcataacgtcgatttctacgctagtggtatgcccagtcggattgaatttaagcagatgttcggtattgttaaaactcaaaaattaactaaaacagatatcatgcaacttggaccaaaattaaaaatagatcaagagaagatcaacttcatgataaaagtgttttttgagttgaattttgttaaaatagaaaacggacttcttttcatcaatgctgaagcagaacagcaccaacttactgaggcaccggcgtataagaagcgtgaagaattaattcaaactcaggaaaaattactctatagtagtggtgatgaactatcagctatagttgaaagactgatgaatgttgataacaaaggagtgtcgtaaaatgacattagacttacatgactacgttgcaagtattcaagatttcccagaaaaaggtgtaacattccgtgatatttctcctttaatggaaaatggtgaggcgtatcgtcaagcaacaaatgcaatcattaaatttgctagagataaaggcgttgaaatgattgtgggacctgaagcacgaggatttatcgtgggatgcccggttgcctatgaaatgggaattggttttgcaccagcacgtaaaaaaggaaaacttccccgagaaaccgttaaagctacttacggtctagaatatggaaaatcagaattgtatcttcaaaaggatgcgatcaaacccggacaaaaggttttaattactgatgatttactagcaacgggtggaacaatcgctgctacgattgaattagttgaaaaattaggtggtatagttgtgggaactgccttctttatcgaattaaaagacctcaatggccgtgaaaaaattaaagactatgatacattaagtttgatggaatattaattaaatccttaaatatctacttattttagcttgctagtccaatgactagggagcttttttatttaaaatggtacaaagtcgtacaaatctttttcttaataatttaagtgtttattcatcaatatgcttattgaagttagacaattatagagtgacaagatcgactaatgtaaatttgtaataaacaactccgggtcttgataacagttagatcagggcataaaaattctgtactcattaaatttattaatctactaattctttatgattggaatgttttttggtgaattagataaattggaatttttcgaaaatacttttaaaatgggaaccaacttcttaatttctagtgattttctaaccggaactacaaaaataaaaaaatagcttaatgccttgatatgaaaggttttaagctatttttatttctaacaagcggtaattcttgttagggtctaattggtattaataaggagagtacaggatttgaacctgcgcgccggtattagccgggtcgtcggatttcgagtccgatgcattaccactctgccaactctccataacactataattctatcaaaaataaaaaggtagtgcaatagagtttagacgtaatggttcaaacgcttgtggggtagtattctaaaagttaattcaaatgagcttaaactaactttttaaaagtgtgctagaattaaatattatttttgaattacctaaaaagattatttaagtttaaaaagaaggatttaataatgcgagatacaattaatttaatgcaacatcatacatccgtgcgtaactttatgccggaaccacttcctgaaagtgtaaaaaatcaattagtttcggccgctcaaagtggttcatcttcgaactttattcaagcaacttctattattgaggtgactgatcttaaaactcgtgaaaaaatcgctaaaatttccaatagtgatgcatatgtaaaacaaagcggggccttttttgtttttatagcagatttgtatcgacaagctaatatcctaaaacaggcccaattaccattagatgggattcaaaatatggaatcgcttctagtaggagttgttgatacggccattgcaggtgagaacatggcaattgctgctgagtccctagacttaggaatctgttttattggtggaatccgaaatgaaatggatagtattaaggaactacttggtttacctaaatatacagtgccactttttggaatgactgtggggattccagttcaaaaaaatgaaattaagccacgtctacccaaaaagaatatttcttttaaaaaccgatatgaaccatcggttgcagtaaatctggatagttataatcaacaaactcgtgagtattatgctaatcgttcaactgctccccaaaatacggattggtctcataaaatgcttcatttttttgccgaacccaaaagaccagcagttgctgaatttcttaaaaaacaaggattttcactggaataaaaaatgcattactagttttaaaactagtagtgcatttttattaaacaatcttttttctagtaggtaaggcttgtagaaatgacgtagttaaaattaataacccgccgattgtttcagctaacccaaaatgaactcccaataaaaggattgaaagtaatgtggcagttaaaggctcaaaagagctaagcatcccagtcgtatcgggcttcaaataatttaaactacttaaatagaataggtaagataacatagttccaccaacaataatgtatacaatcaataagatagaagcaggatcaatggaggcagggcgattagttatgattatcttagcaaatggaatgcttccaatcagcatggcccaaccagtaactaaagctgcatcaaaattcttaagtaagcgacgaggaatcaaagtatagttagcttgtccaacacccgccattagtccccagaatactgctaaaggtgctaaagcaagactaccaaggttacctttagtaactagtagtaaagttcctattagggccacaagaatggagataacatcaattcgtcgtggcaaagttcggcttccaactgccaaagcaagaatgatgaataaaggacccataaattgaaggattgtcgcagtagctgcatttccaaatttgatagctagaaaataagttaattgagatggaaccataccaagtagggcaaagagtatcaaccataaaatattacttttagtataaaaaatggtaaaaatcttcctaccattttttaaaaaactataaacgattaacagactaccagccgtaagtagtcgaactccgaccaaccaaatggggtcaattgactgatgatgaaaaacaaattgagcggctgttccggagccaccccagagcacggtacctaagattgcaaataacaaaccttttgttttattttgattcataagaacacctatccgtatactcaaattcaataatatctatcatacgtggattttccattaaaacaaagcctttttataaaagaatcaactccaattagaaagtatttctataaaatgtttaagatatttacttttaaactaataagagaaggatggatgaatttagaatggtgttaatctgtaaaaataataatagaatgaaaaacgattcttgaaacgctttaaaagttattaaaacgccgataatagacattcgaaagcaacctaattattttacttttgcctaggaatgggatagaatgaataatcatacatacggaagttaaaagaaaaattagtcgaggtgatcaacaattctaaagaaaacaaaacaatttttgagaagcaataatctacaatatagtaagaaatatatccggccgatgatgacgccaggaagtgtttatgtttttaaatttggcaaagacgaacttaataatcgagcaattattaattacacccatacatggacgggtcgaattaaaattactgagattgatttacgtctgcatgaacaaaagcatcctcgtatctttcgtcgagaaagtgatttattagcttatttaaagaaacatctaacggaaactgatggagttactaacataacacgccgtaaaaaacatcattccaaaaaaataaaaaagtaaattgactattgacgccattaagttttatgcgtagtatagtcaattaaagaaaagaaaccttaatttggtcctgtgaggccaaaaggctcaatttgttcggtagaacctcgcacttaacggggaatcatagaatttactgaagcctcttggatcacatcgatctaagaggctttttctatgaaaggaagtacgtggttatggcaaagaaagaagaatatcacaatcctgaggcaattttggatatccatgataaagtaaagtttcctcagttggtaggcctatctattcaacatatgtttgcaatgtttggttcgaccgttttagttccaatcttagtgggtttaaacccaggaatcgctctttttagttcaggtgtgggaacgctgttatatatcttgataaccagagctaaaataccagcttatatgggttctagttttacatttatcgttccaatgctggcgttaatgaaaacaacaggctatcaaggcattgcacaaggaactatctcagttggggtagtgtatctgattgtggctttgttgattagttggatgggttcggattggttggataagatattaccaccgattgttgttggtccaattattatggtgattggtttatcattagcaggaactgctgctacagatgcaactatgcgatccgttggcagtcaaagcgtgtatgatatcaaatatttcattatcgccctggcaacactgttaatcaccattgtatttaatatgtatctcaaaggctttattagtttaattcctattttgttaggtttaattgctggttaccttatcgcacttgtcatgggagtggtcgatttatctactgttcaacaagctaaatggttagttgctccaaattttgaaattccatttgtaagttatcagatgcacttcaacatcggggccgtattaagtatgatgccactggcattcgtaacgatgacagagcatactggccacatcatggttttgaatactttaacccatcgtaatttctttaaggatccaggactacactacacactttcaggtgatggtgtggcatcgattgtagctggttttattggaggacctcccgtaactagttatggcgagaatattggagtacttgcagttacaaaagttcacagtgtctatgttttgatgggtgcagcggtgagtgcaatcatctttagtttcgttggaaaattaagcgcattgattcaaagtattcctaatccagtaattggtggaattagttttctactatttggaacgattgctgctaatggtctacggattttaattgataataaaatcgactttaatcagaaacgtaatctaatgattgctgcatcaattttagtaatcggtattggtaatgctagttttaatattggtaatttaagtttctcaggattagcagtggcaaccgttttaggagtcattcttaacctagtccttcctaaacaagctttaagtgaaaaataatttacttttcgtatatttaagcaaaatggtatcatagtatctaaacacgagatattataggagctgattttgtttgaaatggactgaagtaaacgtcaaaacaacaaacgaggccgtcgaagctgttagcagcattttcgatggcctcgatgctgttggagtgaaaattgaaaatgcactagattttgagaattatcgagctagtaatcctgcagaattaatggaattaaaagatattccacatattactgaaggtgcaatcgtatcagcatactatccagacgatacaacaaatattgacgtaattttaagtcaattacgtactaaggtgaatgcattagttgactttggacttgatattggagaagccagcattacgacggttgaagtgcaggatgacaactgggctacagcatggaagaagtattatcatccagtccgcattacccgttatttaacggtaaaaccaagttggagtgattaccaagcaagtttcagcgatgaaaaggtaattagcttagatccaggaatggcttttggcacgggaactcatcccacaactcgtctttgtcttcaagctttagaaatgacgatgcgtggcggcgagacactttatgatgtcggaactggttcaggagttttaagtattgctgctaaacacttaggagcaagtgatgtagaagcttttgatgtcgatgatattgcagtcgcagccgctcaagaaaacttcgatttaaatccaattgctaaggatattaaagttggtgctaatgatttattgaaagggattaatcgccctgtagatacaattgttgctaatattttatccgatattttagtaccattgattccgcaagctaagcaattgcttaattccaatggatatttcatattatcagggattattgatgataaactagggttagtgatagatacattgatagccaatgattttaaaattgaagaagttctacattacggtgagtggcgtggcgtgattgctactaatcggaaagatgattaaggagaaactatgcaaaggtattttgtaaaacagcctcttaagatccaagctgaatttcaactttcgaaagaagattctcatcatcttattcgagtaatgcgtactgatattggtcaagatgtggaagttgtagatccagatggtaaagttttcattgcggaagttttgaagagtggatcaattgcaactttaagaactaaagaagatattactaagtcagttgaactaccagttgatattacgattgcgtgtggaatttctaagggtgacaaaaacgaacaaattattaaacgcggaactgaaatgggagctaagcactttatattttttgagtcgcgttactcggtagctcgttggtcagaacctaaagtggagaagaaattaaaaagactgcgtgaaattgccaaaggtgcggctgagcaatcacatcgccagcttattcctacggtggtatttattaaagcgcctgcactatttgaaacaaccattgagcatcgaatggtagcttatgaagaatcggctaaacaagatgaacatgctaattttaaatcgcttctattgcaactaaaggctggagaccagcttttagccgtcttcggtcctgaaggtggatttgcagaagaagaaattcaagaatttactgagcatcaatttgttttagcaggtttagggccaagaattttaagagcggaaacagctccgatgtatttattatcagctgtatcttatcaattcgagcttaagtaataaggagaaagacaatgaaaaaaattaataaatggggactttctattcattggcgatacatacttttcgctttcttaattggaattgtccttccaataattttaaaactttgccatacgccatcggtaatgattgttttatggctattaattgtatttaatgttttggcaagttacacgtttggaaatctaataaaatcaaatggattacatttcatttttctatttgtttttcctattttatatttaataggggcttttattattttgcctcattattcatattattttaccatcgtatatttatgtgtagaattactgtcgtataacctttctaacggctgaatattgcaatttattatcaataaacgtatacttaactcaataaaagcgaagcacgtagtcatttgattccgtgcttttattgtattttgaggttggtggtgatattaatgtctaaagaaccagtgttaacggcaaatgaagtaattaaaatgtgccaggagtacatgaacgaagaacatgcagcatttgttcaaaaagcctgtgattttgcgtcatatgtccataaggaacaatatcgtcaatcgggcgaaccatatattatgcatccgattcaagttgcagggattttagccaatctaaaaatggatcctgaaacggttgcagctggatttttacatgacacagtcgaagatacactgattaccttaggtgatatcgaagaactttttggtaaagatgtggcagtaattgtcgatggtgtttctaaaatcagtaaaatcaaatataaatcaaatcaagaacagttagctgaaaatcatcggaagttgcttttagctatgtcacaagatatccgagttattattgttaagcttgcagatcgcttgcataacatgcgaactctacaacacttgcgccctgataaacaacgacgaatatcaaatgaaacgttggaaatttacgcaccactagccgaacgcttaggaattagcacaattaaatgggaacttgaagatatttcactgcggtatctaaatcctcaacaatattatcgaattgttcatttaatgaattcaaggcgaaatcaacgtgaagaatacattgattccgcgatttcagaactaaaatcagcggtcgaagatttacaattaaagcatactgaaatttatggaagaccaaaacacatctattccatctaccgtaagatggtcgatcaacacaagcaatttagtcaaatttatgacttactagcaattcgagtgattacggtgtcagttcgtgattgttatgctgtgttgggcgctatccatgctaaatggaaaccaatcccaggtcgttttaaagactatattgcaatgcctaaggctaatatgtaccaatctttgcatacgacggtggtagggccagaagggcgaccattggagatccaaattcgtactcaagcgatgcatcgtgttgccgagtatggggtcgctgctcattgggcttataaagaaggcattaaagatgagttggctcaaaatacaacagatgcgaagttaaactggtttaaagaaattgtcgaacttcaggatgaaagtaatgatgcagccgattttatggaaggtgttaaaggggatctgtttggtgatcgcgtttatgcatttacgcctaagggggatgtgtatgagttaccaaagggagctggtccactagacctggcttatatcatccatactgaagttggtaatcatgctaccggagctaaagttaatggcaaaatcgttcctttagattacaccattaaaaatggtgatattgttgaaattttaacttccaaaaattctgctgggccgagtcgtgactggattaatctagtttctactcgacgtggacggaataagattaaacaatttttccgccaagttgatcacgaagaaaatgttgaaaaaggacgagacatccttgctaaacaattggaacaaacagggtacgatgtttctgatttgatggatgatgaacatttaaaagatgttgctaaccaaatgaacttctcccaaattaatgatttgtttgctgcagttgggttcggtgatttagctccggcgggaattgctaatcggttaaccaaggatttacgtaagcaagcagaagaagatcgccaacgagaagaacaaaaacaattgttagaaagtcatcaaacaatctctaatgaaagtaatgacgatcgtaagaaaaagaaatcttcttctgaaggcattgtaattgagggtgcggataatttattagttcgcttaagccactgttgtagtccagttcctggggatgaaatcgtgggatatattactaagggacgaggagtttccgttcatcgggtcgaatgtcccaacgtccgtcaagctgaagaaaatggtgaacgcattattgaagttagttgggaaaatcctaatgatgaatcaggaaattactctgctgacttggaagtagaaggctacaaccgtaatggcatgttaaatgatgttttgaaatcagttaataactctactagaaatctttcatcagtgaatggaaaattagatcataatcggatggtagtaattagtatgactatcggagtgcgaaatttattacatttacaacgagttatggaaagcttaaaaaatgttaaggacgtttatgtggttaaacgtccaacccattaggagtaatgtatgagagttgtaattcagagagtatcaaaagcaagcgttacaattgaagagaatgtagttggaaaggtcgggccgggattcatgctattagtggctttcaacgatgaagatacggacgctgatctcgactttgcagtacgcaaaattgttaatatgcgtatttttgaagacgagcaagctaagatgaatctgtctattaacgatgtaaaaggagcgattctttctgtttctcaattcaccttatttgcttccactaaaaagggaaatcggccgagctttactaaatcgggtaacccagagttggctagtaaactgtatgatcagttcaatgctaagttacgtgctacaggaattgaagtacaaactggtcaatttggggcggatatgcaggtggaattggttaacaatggaccggttacgattgttttagatacacaaaataaagaatgattgaaagagcttaaattagaagtcttagactattgttggcgtagagcaaacatagtttagctcctaagataagctcttttttaaggagaaaattatggatattttttatgattttgacggaacgttatttgacacatacccagcgatggtagctgctttggtacaaacagccgttgattaccaggttaagattgaccgaaatcaagcctatcagcaaatgcgtcaaggatccttgggggatgcgattaaagttttagctcgtgtagctaaggttgaaagtactacaattgaacatcattttcgagcaattgaaaacgaggaattaaaaaatagtcaaccatttgaaggtgtaaaggcaacgctagagtcggtagtaaaccatggtggtaaaaattatttgctaactcatcgaaatcaggcggcaattactttactagaaaaatttgaaatgaaaacttggtttgaagactttgttactggagacatgactttcccaagaaaacccaatccagcttcattaaattatctaattgagcgaaatcaagtaaacaaaaaaacagcatatatgattggcgatcgaaacttagatatcgacgctgcacataatgctgatataaagggaattttatttgatcatgaccaaattattaatgtaaccagccacccagaattaataaccaataattttaaagatattcagacttatctagataaaaaattgattaatccttgatgaacagctttggcgaccttttttggataagaagcactagacaattttttgaaatcagagtcggtgttgatgtatccaccctcaattaaaattgctggacgtttgttatcacgtaagacctgataattagcgaatttaacgcctcggttgtaaagaggaacatcattaatcaattgtttattaatggctttgcctaattcaatcgaaccgttatcgtgataatagtaggtagtgtctccagttccggcattattttcaccagaagaatcaaaatggatactgataaaggcatccgcatgatttcggttagcaatttggggacgttcagctaattcgataaaactatcattatcacgggtcataattactttagctccactgtgatctaatttactttgaatggccttagatacacgtagggtatatttcttttcttcatgggattgatcgattcctaaagcacctgaatcaaccccaccatgtccggcatcaatgacaataattgattctgctaaaggagtttctttctgacctttaggaaaagaacggttggtaatccaatcgggaatccagcccattttagtgtcatcataacgaatatgataccagtggttagatttggaaagtacgcttaccgtttgatattgattgagggtcccaattttttttgacgttcggctattagaacttcggattgcaacttgatccaaacctacgtatacggttttagaattaaaaagtggtagaatcaaaaaaattgctacagccccaaacgcaattgatagaccaatttgaacaaggtttcttttaataaagttaaaaataatttctttattcatgctaatctctcttaatttattattattagtatccattatagcaaatttttaagggtacttacttgaagaattcgccttgactaatatggttttttctagtacttttataactaaagttaatataaatcgatgaaaaggactattaaatattgacgacatggctaagagagctcggttgctgaaaaagagtgcatgcgtcgtattgaagacaccttggagatttggtcggcacccattatatatgccgtagagtacaaatctaaggtggtaccgcgtcaagacgcccttgttaaatcaagggtgttttttattttctttgaaaaatatttgaggtgaatataaatgaagtatcaaaaaccaaagggaacagcagacatattaccgccattttcaaaagaatggcaatttgttgaacagaatgctcgcgaaacatttgcactttataactacgaagaaatccgtacaccaatttttgaaaagtttgaagtcttttcaagaagtgctggggatacatctgatattgttaccaaagaaatgtatgattttgatgataaaggtggacgccacattgcgttacgtccagaaggaacagccggagtggttcgggcatttgttgaaaataagttatatggaccagaacaccagaaaccggtaaaagtttactacatgggaccaatgttccgttatgaacgtccacaatctggccgactacgtgaatttcaccaaatcggggtagaagcattcggtagtgatagccctaaaattgacgttgaaacaatcatgatggggatggattttcttaaaaagttgaaggtttcgggactaaaattagttatcaatacgctaggtgataaagagagtcgtgatcgttaccgccaagcattgattgattatttggaacctcattttgaagaattgagtgatgattctaaagctcgtctccataaaaatcctttacgtgttctagatagcaaagataaaaacgatcaaaagattgttgaaaatgctccggagattttagacttcttaactgaagatgctcaaaagcactttacaagtgttaaagaagaacttgatacattaggagtagactacgttgtggattcatccatggttcgtgggttggactattataaccatactatttttgaaattatgattgcagattctcctttaggaaagggagatgttactatctgtgctggaggtcgttataatggtttggttgaagaattaggaggacctgaagtttctggagttggttttggactaggagttgaacgtctgctcttattattaaatgctgaaacacaaaccactcttcaaagtaaacaacttgatttttatgttgttggaattggcgatcttgttcaaaatgatgttcttaaggttgtccatgaactccgtcaaatgaattttgtaactgaacaagattatcttgatcgtaaacctaaagctcaatttaaatcagcggataagctgaacgctaagtatgtggttaccattggcgaatctgaaatgaatgatcgagtctttaaattaaaggacatgcattctggagaagaacgtaccgtagcattaagcgaaattaatacattaaaagatcttttaaaataagcgaggaagactaatgaaaagaacaacatacgctggtttagtaaatgaacagtatactggccaaacagtaactttaaaaggatgggttcaaaaacgtcgtgatttgggacaactaatttttattgaccttcgcgatcgtgaagggatcgttcaattagtatttagttcagaattttcggctgatgcattgaaaattgctgatcaattaagaaatgaatatgtccttgaagtaactgggattgtcaaacaacgtaaggaaaaagacgttaatcctaaaatgaagacgggacaaattgaagtggaagttcaacaagctaagattttgaactcagctaagacacccccatttgatatcgaggatggagtaagtgcctctgatgaattgaagatgaaatatcgttatttggatcttcgtcgcccagaaatgcttaaaggtcttaaaatccgtaatcgaattacgcaagctgtgcatagttatcttgatgaacaaggtttcttagatattgaaacacctgacttaacaaaatcgacacccgaaggagctcgtgattatttagtaccttctcgggtttacccaggacatttctatgccttacctcaatcaccacagttgtttaaacaacttttaatgggagctggaattgatcgctactaccaattagcacgttgtttccgagatgaagatttacgtggggatcgtcaacctgaatttacgcaaatcgatttagaaactagttttttaactgctgaagaaattcaagatattacggaaggcttaattgctcgcgtaatgaaggacactttggatattgatgttaaattaccatttgatcgaatttcttggaaagaatcgatggaccgctttggtacagatcaacccgatgttcgttttgggatggaattaaaagatattagttcaattgtggctgactcagaatttaaagttttcagtggggcagttgctaacggcggagtagttaaggcgattgctgttcctgatggagctaacaacctatctagaaaagacattgataaactaggcaaatacgtagagcgctttggtgctaagggattagcttggttgaagattacagatgatggtttcagtggtccagttgctaagttctttaatgcaaaaactgaaaaacaaattatggaacaaacaggggctcaagtaggggacttactattgtttgctgcagatcgtgccaaggttgttggtgatacattgggttatctccgtgttgaacttgctaaacgttttgatatgatcgatgaggatcagtttgctttcctttgggtagtagattggccgttatttgactatgatgaaggtgaccaacgctgggttgctgctcatcatccatttacaatgccaaatgaggaggatgttcattatctagatgaaggcgaagaccctcatcaagcccatgcccaaagttatgacatcattttaaatggacttgaactaggcggtggttcaattcgtattaacacacgtgaacttcaagaaaagatgctgaaagcacttggcttcagtctagagagtgccaatgaccaattcggttacttactaacagcgctcgattatggtttcccaccacatggcggtttagcaattggtttagatcgttttgctagattattagctaaacgtgataatattcgtgatgttattgcattccctaagaattctaaggcatcagaaccaatgacagaagctccaacaatggtttcagaagaacaattagctgaattatcattagatattgatgttcgtaaaccagaagactaataagaaactagaaaaaagaggatggttaaatcctctttttttattggattatatataaaaaattattaaatgagtatcagtcttcatttcaagtgactgaaaatgttatattaaactagagttaaataaactaagaaagtgattgatatatataatggatcatcaaatcaaaaaaattgcaaaacgtcaccaatacgtggctagaatttcaacatcgtttatctatgcgatcttggtttcgatcgcgatgaactttttttggacgccgggccatatttatgcttcaggtattaccggtgcagctcaggtagtatcaacggttttaaaaagatttttgtcaatggacgtttcagtcgccattttacttttcgctctaaatgtaccgttgttcatcttagcttggattgcgattagtccacgttttaccgtttttacggttatttccgttggtttagccagtgtgatgattaagtttttacatccaatgactttgacaacagaccctataatttgtgcaatttttggtggtgcagtcaatggttatgggacaggtttagcactcaaaagtggtatatcgaccggtggtttggacattttaggaattacaattttgcgtaaaacagggcatagtattggaagtatcaacattgcctttaacattttgatcgttgtagctgctggctttctatatggctggccatacgctttttattcaacaattggattaattgttaacgctaaagtaatggatatgacatatacacgacagcaacggatgcaagtgatgattattacggaccgtcctaagagtgtgatcgatagtatccaaaataatatgcggcgcggtattacaatcgtccacggggcggaaggagcttataatcataaggataaaaccgtccttttcaccattgtatcgcgttatgaaatgccggaattggaagcggcgatggaggtctctgatccccatgcctttgtaagtatcaccgatacgattaaaatattaggacatttttacgagcctactttgtaaggagtttattttgaaaaaaatatatttattactagttagattagctcgtttggcgtttggcgccaagaaggcacagtaccaagtagcctattttatgagctttgctggtaacgaaacttttattagagagttagtaaaacagtttggttcagacgaagttttaatcgtctataaaacaaacgtcaaagaaaatgttttacagttgcaacaggggcacatcataaaacatgccatcgagtttaaaaagtttcaagttacgagctttgttaaaggcatcaagttggcccgagtgacactttttgacaattattatccagaattaagtgctatcaataaaaccaaaaaagattatttcattcaaatgtggcatgctaacggagctattaaagcttttggttgggaagatccaagtacatatcatcgttcggtggaagatcaacaacgttttcagcgagtttatgatagttttgaccaaattgtagttggttctgaaaaaatggctgatgtttttcagcgaagttggcatgtagcttccgacaaaattgatcgaattggatatccacgaaccgataaatattttgaagaaagttggatagaaaaagcacgaaaaaaaattcaaacaaaacttccagaattaacccaaaaaagagtgattttgtacgcaccaacttatcgcaaagatgtttcatttagccttccagacgactggcgcaaaattaaggtacctcaggatgcagtattgatagtacgtttacatccccacctagctaatgtggaacgtcaaattgttgatgcatctcctgatcgagtgataatggtggaccattttatttcaactcaggagttactctgtgttgctgatactctgattactgattattcgtctatagcttttgattttagcctattagataatgcgcgttctgtaattttcttcacttatgacttagaaaagtttgaacgaacggtaggaattcaggctagctttaaggcagcctttctaaaccaaatggtaaatactgtggaacaacttaatgacgcaattttgtttggcaattcagataagaatgtgattcataaattaaatcaacaatggaatacattgaatgatggtcattctagtgcccgattaattaagcaagttaaagagagatgtacagatgagtaatttaaaaaaacaactaaaaattatcattcgctacgtattgattgttatcaacgatattttaactttattacccattaaaaaaggagtagttttatttgaaagttttaatggtaagggattaaccgataaccctaaggcaatttacgatcagcttttggagatggataatcaaactgctaaactactttattggggaattaaaggtcaattttatgatgaaattgtacaacaatatccgaatgctcaaatcttaaaaagatggtcattaaaatggatttggatttcagcaagagcaaattattggatttttaattcaagaatgcccacttggtggaagaaaaatcgaaatactaaatacgttcaaacatggcatggtacacctttaaaacatttagcgacagacatggatcaggtgaaattacccggaagcacgcgagaaaagtacttaaaagaatttgttagtgaagctaaacgatgggactacctagtagctgcaaaccaatattcagaggatattttcaaacgagcttttcgattcaaaaaccaatttctagaaacgggttatccgcgtaatgatatattagttcaaaaaaatcaaccaactgagattaaggcactaaagcaaaaaatcattggcaatggagaaaaaagagtcgtgacatatgcgccaacatggcgagaagatgattttatcagtgttggacattatcattttagatggcattttagtctaaaaaaaatgatgggattacttcctgaagatgtgatgttattaattcgaccacattaccttgtaacagatcgaattgatattaagggatttgaagatcgcgtagttattgattcaacaactgatatgaatgaaatttatctgattacagatttaatggtgacggattattcatctgtaatgtttgattttgctattttaaaacgaccaatgttattttttgcgtatgacttggaatattaccgagatgatttgagagggttttattttgattattatactgagctaccaggttccattgttaccgatgaaacacatttattagctgaaattgatcaacttcttcaaaataattttgcggagcttgatccagagcgctttaacaaatttgccaagcgttttgtaagttgggaaagagggacagctgctcaacaagtcatagaaaaaattaactatcggagggatgaaaaatgattattggttcacacgtcagtatgagtggaaggaaaatgtttttaggctccgttgaaacgagtattgaaaatggggcaaatgctttgatgatttatacaggagctccccaaaatacacgccgcaaagcaattgaagatttacgtattcctgaaggacgcgccttacttacagaacatgattttaaagacgtcgtggttcatgccccatacattgttaatttaggaaatacttttaaacccgaaagtttcaaattcgccgtggaattcttaaaagaagaggttaaacgggctgatgctttaggggctagccagttagtcttacatccaggatcgcatgtaggagcaggtcccgacgctgcgattgcgtcaattactgagggattaaatcaaattattacaccagagcaaaatgtgaagattgcgttagaaaccatggcgggaaaaggaactgaagttgcaactaactttgaacaaattcagcaaattattactggagtagagcacaacgaaaaattatccgtatgttttgatacatgtcatacgaatgatgcgggatatgatgttaaaaaccatttcgatgatgtaatggatgaatttgaccaaattattggtttgcagaaaatcggcgtaattcatttaaatgattctaaaaatgaaatgggcagtcacaaagaccgccatgaaaatcttgggtttggaaccattggatttaaggcgctacattatattgctaattttgataaatttcaaaacgttcctaaaattttagagacaccatgggtaaaagatccagatgctaaaaagcattctccatatcaactagagcttgcaatgcttaagagtggtagatttgatgatacattgattgaaaaaatcatcaataattaaaaaatgtcatagggcaatgtgataacgagatatttatctcggtgccttatgacattttttggttttatacgagactttccataataattgtggcggtctcctcgatggatttattagcagtattaattactaaacaaccaatttttttaaagagttcgtctgcagattgaagttccttattgatactatccatattagaataggacgattctggatttaaaccgtaagcaatcatgcgctgccgacgaatattatttaaaacttctttagtggtagttagtccaaaaatcttattagagtctacctgccaaatttcatctggaatttgagtttgaggtaccagaggcaaattagcgaccttgtagcccttgttagcaaggtagagtgaaagaggtgtcttagaggttcgagacacccctaagaggacaatatcagcttttaagaagccagcagggtcttttccatcatcataggtaaccgcaaactccattgccgaaatcttatcgaagtattttgcatttagtgagtgggtgcgtccaggtttattttcaggggcgagattagttttttcagcaaataaattcactgccggagtcaatacgtccaaatattttaaagtgttttggttacaaaaatcggcagcatattgattcaattccggatttacaaaggtggaaaaaaccattgcatcttcacggacggctttattcaaaatactatctagtaaagagattgtatgaataaacggatgacgagcaaaattaaattccacatctagaaattgagcggctgctgcatgagcgacttgatcacccgtatcaccgacagaatctgaaagaatgtaaatattaattgattttttttgtttttccatattgtttaactcctcagtcttttggtatgatattaacatagttgctttaagttagaaaacgttttctgataaataaataattatcgccacagttatttattttatgttgacggtcataacttattcagttataatatttaagaaacatgagtacttagtacgaattgttatttcgaagctcggagggagggaatcacattgtcaaaaacagttgttcgcaaaaacgagtcacttgatgacgctcttcgtcgctttaaacgtacggtgtcaaagtccggtactctacaagaatatcgtaaacgtgaattttacgaaaaacctagcgtaaaacgcaagttgaaatcggaagctgctagaaaacgtaagaacaagaagcgtttctaatccgatcattgctcctgaatttcaggagctttttttgtatacttaaaagggagatttaaacatgaattttactgaacaacttaataatgatttgaaaacagctatgaaagcgcatgataaacttagtttaagcgtgattagaatgattaaatctgaaattttaaatgaacaaggacgagttggccacgaattgaatgatgaagactttgctgcggttatcaatcgtgcttacaagcagcgcaaagagtctatcaatgagtttcaaaagggtggacgtgatgaccttgttcaagaaactgaagcagaattaaaagttgttgaaaagtatatgccagaacaattatctgacgaagaactccaaacgattatcagtgatgtgattgctgaaacgggtgctacttctaaagctgattttggtaaagtaatgtctaaattaatgccaaaagttaagggaaaagcagacggttctaaagtcaatgaaatcgtaaaaaataccttaagttaggggacgtttacgtgaccgaagaagtatttgaaaaaaatctaatattatctgatccaaatttagaagtttcactattgggaaatcaggaacgtttcatcccggtgcttgaagaagggatgaatgtaaaagtattaccatttggtgaacgaatcacaattaaaggttccaaaaatgcagtcgaacaaacttacgaagtactgaagactttattaaaaattttaaggtcgggtgtccaattaaacagcgctgattttgtaagtgcaatgaaaatggttgaaaagggaactttggattatcttccagatttgtattctacaattttgattaaagatgctaaaggaaaaccagttcgaatcaaaaactttggtcaaaggcagtacattcaatccgttaacgataatgatgtgacctttggtattggccctgcgggtactggtaaaacatacttagcggtggttatggccattgcagccttgaagaaaggtgaagtggaacggattatcttaacacgtcctgcggttgaagcgggtgaaagtctgggatttttacctggggatttaaaagagaaggtggatccttacttacggccagtatatgatgccttgtatcaaattattggtgcagagcataccacacgcttgttagatcgaggagtcattgagattgctccattggcttatatgcgtggtcggacgttagataatgcctttgtaattttggatgaagctcaaaataccactaatcaacaaatgaaaatgttcctgacccgtttaggatttggttctaaaatgattgttaatggggatgttactcaaattgatttaccacgtggtacgcgaagtggattaaaagaagcacaattggttttacaaggaatcaataaaattgaattcgttaactttacagctaacgacgttattcgtcatccggtagtggctaagattgtacaagcctacgatgacaaagaagcgaaaggataaatctgatggatattcaaacatttgatcatactaaggaagaaaatcctaaaaatctcgaattaattaccgatattcttgaatttgctggaaattatttgcatttagatgaagaaacggaaatttcagtaacattaatgcataatgatgaaatacatcaaattaataaagagtatcgaaacgttgatcgtccaactgatgtaattagctttgcaatcaacgatgcagatgaggatattattatggatcctgaaatggcggaggaaattccggcaaacatcggagatttgatgatttcagttgataaagttgctgaacaagctgaatttttaggtcattcttatgagcgtgaattaggctttttatgtgttcatggtttccttcatttaaatggatatgaccatatggaaaaagaagaccaagaaaagatgttcccccttcaaaaagaaattatgaatgcctatggcctcaagcgataagcatcaaacgaaaaaaaatcgttcaatcttccaatctgtaggccacgcgggccatggattgagggaagtgtttaatactgaacgtaatttccgttatcacttgatgattatggttgtcattattattgcgggatttatttttgcgttgaatttgttggaatggattatgattttaggatgcattgcagcagttttggttgctgagattttaaattcagccattgaacgattagcagatttagctgctgacggtaaattccacccgttaattaagcaagcaaaagatattgcagctagtggtgtgcttgtcacagcgctatttgcggccataattgggttattaatttttggtagtaagttattctaaattaaagaaacggatataaaatatggaagaaaacaatcaagcatttcactcaggatttgttgctattgtagggcgtcctaatgtaggaaaatcaacatttttaaactacgtgatcgggcagaaagttgctattatgagtaacgttcctcaaacaactcggaataaaatccaaggcatctatacgactgatcgagaacaaattgtttttattgatacgccgggtatccataaatctcataataaattgggagactttatggtgcaatcagcgatgtcttcattaaatgaagtagacgcaattatgtttatggttaacgctgacgaacctcgaggagctggtgataattacattatcgaacggctaaagaaaattaccgatcgaccagtctatcttgtgatcaataaaatcgatttagtacacccggacgaattatcaccgattgttgattcatataaagatgctatggattggacagaagttttcccgatttcggcgcttcaaggtaataatattaacgaattggtgacaactttaagtcagcacatgcctgaaggacctaagtattatcctgatgatcaggttactgatcatccagaacgctttgttgtttcagagttaattcgtgaaaaagtacttcaattgacccgtcaggaagttccacattcagttgcggtggtaattgaaacgatgaaatctaatgatgagggattggttaacattcaagcaacgattattgttgaccgttcttcacaaaagggaattgtaattggtaaaggcggaaaaatgcttaaagaaattggtagccgtgcccgtttagatattgaacacttactaggtagccgtgtttatcttgaactatgggttaaagtttctgaaggttggcgtgataaacaaggaattttgcaatcatttggttacaaaaaggatgagtattaaaagtgaacacagtcgccaatgctgattttaatggcattgtaatgtttgaacgaagccatcgcgaaaatgatttgttagttaagtttctaactaaagagcatggtaagcgaatgtttttcattagaaatgccaaaaaagtagattttaagttaagatcagcgattttaccatttagtcatggtcagtatacggggctaattcgtagtaacggtttgtcgtatattaatgctgcactagatgttcagcaatttgaaaatatttttcaagatatcacgttaaatgcttacgcaacctttgttcttaatttagttgatgcggcttttgatgataatgtcaaaatcacatcatggtttgagcggattaatcgcgcattaattttaattgatgctggaaatgatgctgaaattataactgatttaatccaaattcaattattaaattcgtttgggatatcaatcacttgggatcactgtgtgatttgtgggcgaaccgatttgcctctagactattcagaagcgttcggtggaatgctatgtcaaagtcattgggaacgagatgagcatcgttggcatttaaaacctaagagtgcgcgaataatcggaattttaagtgcggttagtatttttaagttaggacaaatctccatttcaaaagagaccaaacaagaaatttggaatttaacagctgatatttataaaaatcaagttggaattaatttgaaaagtcgaagctttattgatcaaatgaaaaaatgggaaatttaagtgatttgacaattaactaaatttcttctatcatcattgtagttaatagaggacagtgaagaacgaagtaggccttataagttttcaaagcgagatcagaatggtgggagctgattaaaacaagtctacagggcatttggagtccgtgtaaaactaagttgccagcgattgctggaagtagggtggaaccgcgactcttgtcgtccctacgtagtgtatttttagtacactgcgtagggatttttttgtccgctaaattaaaaggaggaacttatgaataagaaactttcagtccaagaaattattttaacattacaaaaatattgggcagaccaaggatgtatgctcatggaagcatatgatacagaaaagggtgccgggacaatgagcccatacacatttttacgagcaattggtccagaaccttggaatgctgcttatgttgaaccatcacgtcgtccagcggacggacgttatggagaaaaccctaaccgtttataccaacatcaccagttccaagtagtaatgaaaccttctcctgaaaacatccaagagctttatttaggtagcttaaaagcccttggaattgatccattggaacatgatatccgcttcgttgaagataactgggaaaatccctcaatgggttgtgccggtgttggttgggaagtttggcttgacggaatggaagttactcaatttacatatttccaacaagttggtggtttagaagtaaatcctgtaactagtgaagttacctatggattggaacgtttgtcatcatacattcaagacgtggaatcggttttcgatctagaatggggtaacggagtttcatatggtgatattttcagagaacctgaatttgaacattcaaaatattcatttgaagaatctaaccaagcaatgctggaaaaaatgtttaacgattttgaagctgaagctaatcgtttaattgaagaaggtctagtacatccagcctatgattacattctaaaatgtagccataccttcaatttattagatgctcgaggaacagtttcagttacagaacgtgctggtttcttatcccgtattcgtaatatggctcggaaggtagcacgggcatttgtggaagaacgtgaaaaattaggattcccattattaaaaaataacgaagaggaggcaaaataatggcacataattatttactagaaattggattggaagaaattccggcccatgttgtaactccaagtatcaaacagttagtacaaaaagtaacagccttcttaaaagaaaatcgcttaacatacgactcaattgatcatttttcaactcctcgtcgtttggcaattcgaatcaatgggttaggcgaccaacaacctgatattgaagaagatgctaaaggccctgctcgtaaaattgctcaagatgctgatggaaactggactaaggctgcaattggctttacacgtggacaaggtcttacggttgaagatattacttttaaaacaatcaaaggtacggactatgtatacgtccataagttaatcaaaggaaagatgactaaggaaatccttacggggataaaagaagttgttgaatcaattaatttcccaacaatgatgaagtgggctaactttgattttaaatatgtacgcccaattcgttggctggtttctattctagatgaagaagtccttccttttagtatcttagacgtaactgcgggacgccgaacagaaggacatcgtttcttaggtgaagctgtcgaactggctaatgctgaagaatatgaagcaaaattacacgatcaatttgtgattgttgatgccgacgagcgtaaacaattaatttcaaaccaaattaaagcaattgctgaaagcaatcgttggaacgttacccctaatccaggtcttttagaagaggttaacaatttggttgagtggccaaccgcttttaatgggggatttgatgaaaagtatttagctattccagaagaggtattgataacatcaatgcgtgaccaccaacgcttcttctttgtccgcgaccaagctggaaagctattgccaaacttcatttccgtacgaaatgggaatgaagaatttattgaaaatgttgttcgtggaaatgaaaaagttttaactgcgcgtttagaagacgctgctttcttctacgaagaagatcaaaaacatgatattaattattatgttgaccgacttaaaaaggttagtttccatgataagattggttcaatgtacgaaaaaatgcaacgagttaattctattgctaaagttattggaaacaccttaaatcttaatcaaacggaacttgatgatatcgatcgcgctacaatgatttataaatttgatttggtaactggtatggttggtgaattctcagaattacaaggggtgatgggtgaaaaatatgctcaacttaatggtgaaaaccaagcagtagcccaagccattcgcgaacattacatgccaaatagcgcagaaggtgatttgcctgaaagtgtaacgggcgcggtagtcgcattagctgataagtttgataacatctttagttttttctcagctggtatgattccaagtggttcaaacgatccatatgcattacgccgacatgcatatggaattgttagaatcttaaatagccgtgattggcaattagatttaaatcaattcaaatcacaagttaagactgaattagcggagaatggcacagcgtttggtgtggatgtcgatcaaaactttgaccaagtacttaacttctttaatgaccgtattaaacaattgcttgatcatcaaaagattagtcatgatatcgttgaaacggtgcttacaggtaataatcatgatgttacggaaattatcgaagctgcccaagtactagcagatgctaaagcgagctctacatttaaagatgatattgaagctttaacacgagttcaaagaattgctacaaagaatgaagaaagtggagaacttaatgtagatccacaattatttaataatgcttctgaaggcgaactttttgatcaaattattaaaattgaagctgcaaataatttgacaatgagccaactatttgctagattatgcgagttaactcctgcgattagtaagtactttgacgcaacgatggtcatggacaaagacgaaaatattaagcgtaatcgtttgaatatgatgagtcggttagctaatttaattctaaaaattggggacctaactaacgtacttgtaaaataaaaatgtttttataaggatgatttggatctgcttaaagttaataaataaaacaagccatttagtctaacgagattaaatggcttgtttcttcctatatctaaattaagtaataaaaatgatacagcagcaaattaaaatgtacagacttgacaaaagtgttaaaaacaagggcgttttaattgattctattgcttgactgctgtatcatactaacgtatgagtttatcttacgaaagctggtgagagtatggctggaatgattccagaagatgtaattgatgatgttagaacatctgttgacatcgctgatgttgttggtagatatgtccagttaagaaaggcgggtaaaaacctatttggtgtttgtccatttcatgatgagaagacaccgtctttttcggtttcggagagtaaacaaatttttcattgttttagttgcggacgcggtggaaatgtttttaaatttttgatggatttagagaatcttagtttccctgagtcagttcgtagagtagcggaatttggcaatattccgttagatcagagttatttcaagtcaactaaaaagtcgtcgtatacgtctgaacaaagtgcattgattgatttatatgagaaagcttctgagctatttagtcatattctattgaacaccaaattaggtgaagatgcattacagtatttgaaaaaacgaggaatgaccgaggatgatatcaagaattttgatattggatttgccgccccggaagacaatctcctgctaagtttttttaaagaacataagattgaccaacatttaatggctgaatcaggattgtttattgaatccgaaaatcaaacattaagagatcgattttttaaccgtattatttttccgattaaagatacaaatggaaaaatcgttgcattttcgggccgtagtttggttaaggataagaaccatcctaaatatttaaatagccctgaaacaagcatttttaataaaggaaaggtgctttacaatttttctcaagctcgttcagaaattatccaacagaaaacagtcatattatatgaaggttttatggatgtcattgctgctcatcgagcggctgtaaagaatggaattgcgacgatgggaaccagtttgactgaggatcatattaatgctatcaagcgggtggctgatcgcgtaataatctgttttgatggggatgcgcctggacaaaaggcaattgctagagcaattgagttattgaggcaatctagtgatttacaaattagtgtggtttttattcctgataatttagatccggatgagtatgtgaatcaaagagggacagctgcatttcaaaatttgatgcagcagactggagaatcaagtacttcatttcttttgaaatatgatcgaaccggtctaaatctagctaatgaaaatgatcaattagaatacttaaaacgagctttaaaacgaattagtagtctgaaagatgccctagaacaagatttgtatttaaatcaattatcagatgaatttaagattgataagcgtgatttaaaagaccagttaagagaaagtgtagcagatcgaatcgcgcatgcacccaaacagtttgaattggaagcgtcgacgcctccacctccaccggaggaaatgggagatcaacccgtattcaatcaaaatattcaaaaaaagttatctaagatagatatttcggaatatcgtttgctagctcgtgcattaaataatcatgatgtttggctaaaattacagagcctacccaatttttattttccaaatgaaaagcttgaaacaatttatgtcttggctagtggatatttagaaaaaaatcatgaatataatgttgcagattttatggattatcttaaagaagatgagctacaagcagtcgttgctgatattgaatcaattaacctaagccctgaatttactgaagaagaaattcaagattatcttagcgtgattgaaaattttgctcctttaagtgaacaaatttcaaatgttaaatcggatttagatgaagctactagattaggtaacaaagaattacaacaacaactaactttaaaacttatcgcgctatatcaaaaacaacaacagcttcaaaaataatagggggatcagcataaatggcaaacaaaaaaactgaaacaaaaaagaaaaagagtgaaagtatcatttcttcacctgagtttaaaaaagctgtcaatcaaatcattaaagctcgtaagagtgaaaagaaagttaaatatacacaattaactaaagatttgattactaagtttaaattaactgacgaagatgttgatgatcttattcaacgcattgaagatgctggaattagtgttgtcgatgaaaatggtgatccaagtgaaaaagctttgaaagctcaagaaatttctaaggaagaattagatgatacaaaggctcctgctggagtaaaaattaatgacccagttcgtatgtaccttaaggaaattggtcgtgtatcacttcttactgctgatcaagaagtcgaattagctttaagaattgaaaagggtgatccccgtgcccgtcaagaattagcagaagctaaccttcgtttggtagtatcaattgctaaacgttatgtgggtcgtggaatgcaattccttgatttaattcaagaaggtaacatgggcttgatgaaagctgttgaaaaatttgactatcaaaaaggatttaaattttctacgtatgctacatggtggattcgacaagccattacacgtgcgattgccgatcaagcgcgtacaattcgaattcctgttcacatggtggaaaccatcaataaattgattcgaattcaacgtcaattgctccaagatttaggtcgtgaaccaatgcctgaagaaattggtgctgaaatggatatgccatctgataaagttcgtgaaattctaaaaattgctcaagaaccagtttcattagaaacaccaattggtgaagaagatgactcacatcttggtgatttcattgaagatcaagaagcaactagtcctgctgaccatgctgcatacgaattgctaaaggaacaacttgaaggtgttctcgatacgctaactgatcgtgaagaaaacgtactacgtttgcgctttggattagatgatggacgtactagaactcttgaagaagttggtaaagtatttggagttacaagagaacgtattcgtcaaattgaagcgaaagctttacgtaaactccgccatccatcaagatcaaaacaactaaaagattttctagattagttaacccaagaggttccgtgcaggtcgtagatttgtgcaggacctttttttgaaagatataactataattacgaaagatagtaggggtttattttatgaattcgaataatttgtcaccaagactaaaaatagttgctagtttagtaccacaaggttcaagaattgcggatattggatcggatcatgcgtatctagcgattaatttaattaaaaataagattgctaaccatgcaatagccggagaagtcgctcctggaccgctctctaattcgaaagaagaaatcgaaaagaatggagtagttgatcaaattgaagcacgtttaggtgatggattagctgttattcaagataccgacaccgtcgatgtgatttgtattgctggaatgggtggccaattaattcgaaaaattttaaatgacggaaaaacaaaattaaatggggttaagaaattaattcttcaacccaatgtcggagagttggaattaagagaatggttaattagtaataatttcaaaattacccatgaagatatcgtggcggaggaccatcacttgtacgaaattatcatggcggaacctggacagatgactttatccgagaaagagcaaatgtttggaccaattttaatgaaaagtcataatgaggtgtatacacgtaagtggcagcgcgaattaaaccggttgagaaaaattgaagcaaatctaaatgctcatcctagccatggacaagctaaactagaccaagttactaagcaaattagcgatattgaggagatgttttcacatgttagctaaaaaattaattgaccgttttgaaagcttcgcgcctaaaaccattgcttttactaatgatcctgtgggtttacaaatcggaaatgttaataacgatattaaacgagtaatggtgactttagatgttcgacctgaagtggttgacgaagcaattaaacaaaattgtgatatgattttttcgcaccaccccttgatttttcgacctattaaaaatttagatttaagcaacccgcaaaatcaaatgtatgctaaattaatccaaaattcgattttggtttattcagctcacacaaatttggacgtcgctaaaggtggcatgaacgattggttgacggaagcaatggggttaaatcatgtccaaatggtgtattctaaccattacgataccaatattggtcgcattggagtattaccaactcctgtaactgttgaagaatttgccaaaaccttgaaaaaaatttttaacttagaggggttacgcttggtagcaaatgacaataaagctatggtaaaaaacgttgcagttataggtggtgatggtggtaaattttatcctgaaatgctcaaggcgggagcagatgtgtttgtaaccggtgatgtttattatcatacaggacatgatatgttagcagatggtattaatgtagtcgatgtaggacataacgttgaaaaaatatgtattcctaaattagcttccttattcaacgaatggaaggctaataatgattgggaagttgaaattatagaatcgacggttaataccaatccttatcaatttatctaaaaattgggaggcgatttaaatgaatccagagaaaatgactacggcacttcaagaagcaattagcgaagcacagcagattgctgtaaatcgtcaacatcaagaaattggtgtgccagaattatttaaatttttaacacaaccagaccaactggtcgggacactattaacagacttaaagattgataacaaccttgtccaaaccgagttagaccaagaacttgaacaaattagcgtggttagtggtagccaggttagttacggtcaatcgatttcagcagaactaaatcaattattagttcaagcagaacaacagcgtaaaaaattacaggatgagtatgttgcaattgatactattttaattgctttatttaatttagatcagaatcagtttaaaaaattcctgaatcaacaaggtctaactcaaaaacaggttttagccaaagtagatgaatttcgtgggggtgaaagagtgacatcaaaggaacaagaaagtggatataaagcgctagaaaaatatgggacagatttagttaaaagggcccacagtgaaaacccagatccagttattggacgtgatgaagaaattttagaagttattcgaattttatcgcgaaaaacaaaaaataatccagtactaattggtgaacctggtgtaggaaaaacagccattgtagaaggtctagcgcaaagaattgctaaaggtgatgttcctagcaatttagttgataaaaccattgtttctctagatatgggttcattaattgctggggctaaatatcgaggcgactttgaagaacgacttaaagcagttttgaaggaagtatcaaagtcagatggtcaaattatcttattcattgatgaaattcacacgattgtaggagcgggtaagactgaaggtagtatggatgctggaaatcttttgaaacctatgctagctcgtggtgaactccatttgattggtgcaacaacattagatgaataccgcgaaaacattgaaaaagacaaggcacttgagcgccgtttccaacgggtgctggttaaggagcctagcattgaggatactatcagtattttaagaggtttaaaggaacgctttgaaattcatcatggcgttcgtatccatgataatgctcttgtggcagccgctaaactttctagtcgttatattacggatcgttatttaccagataaggcgattgatttaatcgatgaagcatctgcaaaaattaaagtggaaatgaattccaatcctactgaactcgatcaggtcaaacgacagttgatgcgtttgcaagttgaagaacgagcacttaaaaatgaaagtgatgcagagtcagttaaacgtttaaaggacttacagaaagaattatctgaaaccaaagaagaaaaagttaagctggaatcacgttggtcagcccaaaaagaagaaattaaaaagatcagtgataagaagaatgaattagataaggccaagcatgacttacaagaagctgaaagttcttatgatctcgatcaagcggctattttacaacatggaaccattccagctttggaaaaagaattggaacaattagaaaatcaatccgaaagtgatcatggggattggttggtagaagaatccgttacagataaagaaattgcccaaactattagtcaaatgacaggcattccagttgcacggttggtggaaggtgaacgagaaaaactgctacatttagctgataaattacacaatcgagtaattggtcaagatgaagccgttcaatccgtttcagatgcggttttacgttcccgtgcgggactccaggatcctaatcgtccgattggttcatttctcttccttggtccgacaggggttggtaagacagaattgtctaaagctttagcagaagcgttatttgattcggaagataatatggtccgaatcgatatgtctgaatatatggaaaaagaatcggtttcccgtttggttggagctgctccaggatatattggttacgaagagggaggccaattaaccgaagcggtccggcgaaacccatattccattgttctatttgatgaaattgaaaaagcacatccagaagtgttcaatattcttttacaagttctagatgacggtcgtttaacagatgggcaagggcgtacggttaactttagaaatacaattttaattatgacttctaacttaggttcagatttgctattgaagaatcaatcagaaaataaaattgatgacaacatccgtgaccaagttcaagatgttttgcatggatactttagaccagaatttttgaatcggattgatgatatcattatgtttactccattaagtaaacaagatgtacgccaaattgtgattaaattaattcataatttatctatacgtttaagcgatcaagaaataagtttaagcatttcggatgatgcacaagattatattgttgaacaggcatatgatccagcgtttggggctcgaccattgcgccgctacattactaaaaatgttgaaactcctttggcaaaagaaattattagtgggcgtgttcgtcctaattcaacagttaatatcgacgttttgaatgatcaactggttttccagaataaataaaaaaaggatgctatctttggtaaaaataccaaagacttgcatccttattttttaggttttgaaattagtgggatcatgttagaagtaataagagctactacagctgccacaataccaatttctaatggtgtatatggaagggcatcaagttgtcctccgatatagccaataacttcaccaaagataaatgcccaaaaaataactacgatttgtttcatttcgtttggcccctttctgaacaacagtaattttagcacaattacgtggggaaataaattaaactctatatttttggagaaggggaatttatttagtataattataaaaaacaggaggggataagaatggctttcgtgccactgcaagtattaagttcttacagtttgttatctagcccgattaaaattgatgacttaattgctacggcgaaaaatcgtggatatcaagcgatgaccctcaccgatcataatacaatgtatggaacagttgaattttatcaagcttgtattaaaaacaatttaaagcccatcgtgggtttaacgctttggttagatagcacgacgggaattgacaatcaatttgcgctagttttaatagctaagagtgttaaaggttaccgtaatttaatgcagattagttcggccaagatgacgagtagtacaccaaaatttgcttttgatgatattaaagatttgctagatgatttaatcatgattgttccagcacaaagatcagaaatgattgaattgttggagcgagggctatccggtgatgcaaccgagcttttagaaaattatcgtcaagttgttggtgataaagatctttatctaggaattaatttaaagcaaactaatattatgcgtcaaaccttgatgcaaattgccgaaaaacacagtcttggttgtttacccttaccgagcgtggaatatttaaatagtgaagaccattttgcaactcaagttttgaaggatattgcttcgggggaagttatcaagcatcctgaaatcctagcaaaagaccaagggaataattggttaaaaccgcgagatgtatttgaaaaagagtatcgggatgccggattgagtggtttattagaccaactagatacgctaactagccaaatcgagctaaaaattccgtttgtccagcccaaattaccaaaatttcccacgccagctaatcaatcggctattcaatatttaaaggaattatgctttcaacagttagaaaaaagtaaaaatgctcaaaatttgcaatatcagcaaagattggatcgagagcttaatgtcattgaatccatgggttttgcggactacttcttaattgttcacgatgtggtccaatttgctcatcaaaatcacatcttgactggaccgggacgtggttcagctgcaggctcgttagtagcttatttactcaggattactagtgtggatccaattgaatatggactgctatttgaacgcttcttaaatccagaacgtgcccaaatgccagatatcgatttagatattccagatgataaaagagaattgatgctcaaatatgtccatgataaatatggacatcaacatgtggggcaaattatcacatttggtactttagcagctaagcaagccattcgcgatgttgcccgtgtttttggggaaatgccgaataaaattaatcaaataagcgcgttaattcctagtgaactaaatatcacattggagcgtgctttagaaaattcaagtaagttacaagagtttataagaacttccgaaaaaaatcgatttatgtttgaaacggcgcggcgcttagaaggattgccacgtcattactctacgcatgcagcgggaattgttttgagtgaaaataatttaaccgaaaccactcctgttcaggatggaaatgaaggaatgctgatgagtcagtattccaagaattatgttgagcgggtagggttgttaaaaatggactttttaggtttaagaaatttgtcattaatggctaatattttagatcaagtccatcaacttaaacccgattttgacatcgagaacattaatttaaatgatacaaagactttagaacttttccaacgaggcgataccagtggcatttttcaatttgaatcggctggtattcggaatgtattgagaaaagtgaaacctaatcaatttggtttagtagttgcggtaaatgcgctttatcgtccaggaccaatggaaaatattgatcgatttgtaaaacgaaaagaacatcgcgaacactattcttttcctaatgacgttttatcggaaatcttaggtgaaactttcggtatcttagtgtaccaagaacaggttatggaagttgcttcagcaatggggggcctgagtttgggacaggccgatttgttgcggagagcgatgagtaagaaaaaacatgatgtaattgaacaaatgcggacgaattttattgatggagcattgcaaaagggatataacgccaagttagcccaacaagtttatagttatatcgaaaattttgctaattatggttttaataagtcacatgccgtagcttatagcaagctagcttttcagctggcttatttaaaaacgtactttccaggtcctttttatacagccttgcttaattcagttattggtggtgaggctaaaactaaagaatacattcaagaattgaatcgtttagggattaaagttaaagcaccggatattaatttgagccaactacaatatgcattttatcaacaacaaattatcatgggttttctatccattaaaggattaaggcgagatttcatccgtaatttgattgaagaacgtcaaagtaatggagaatttaaatcagttgacagtcttttacgtcgaatgcgggataagggtattacagaagaaattattgaaaaactaatcttttcgggaactctagattcctttggatataaccgagcggaattaggtgactttttacctgaattgttgaaaggtattgcttttagcgggcaaaacgtggatctttttgaaaagttaatgcctacgattaaacatcgaccagatatggatttggatgaaaagctggattgggaagaagaattattaggaacttacatttctgcgcatccagttgaacgctatgcaaacttgattgaacaaaatgggtttaaaaaaatcgatgaatttagtgttgaagctcaagtgactacgattgtatatataagaagtattcggacgatcagaactaaaaaaggagagtcaatggcctttgcgaatatcacggaccctactggagaaagcgaagcagttatctttccaagaatataccagcatgctaaaattttgagaaacaaacgagtcctacaattacgaggcaaggttgagaaaagaaacgacggtttacaattaattgttaatgaaattaccgcccctcaaaacaaacaggtccaagcagcaatttggaaattagaagtgcctagccgaaataattcatcagaattccaaaccaaactatttgatattttcagaaaatatcatgggaaagttccagttattttagtttatgaggatactaatgaacataatgagttgtctgaaaaattttatttaaatgacagttctgaagtaaaagagcaattagcagaattgctaggaagtcaacatatttcgttaattaaaaaataaattttgaataaagcacttacattcgattaattaagaaaatggtacagacaactgttttcaaaagtgataaaatcaacaatgaagttttgaaaaaactcaatatttctgtttgaggtgaaaagatgaaacgtattggtatcatgacaagtggtggggatgctccagggatgaacttggctatccgcgccgttgcaagaaaggccctaagctctggtcttgaagcttacggaattaactacgggtttgccggtctagttgctggtgatatccacgaattcaaggcagcagatttagacgatatggtttcacaaggtggaacgatgctttattcagctcgttatcctgaatttgcacaagaagaaagccaattgaaaggtattgaacaacttaagaagttcggtatcgatgcattggttgttatcggaggagacggttcatatcatggtgctcttcgtttgacagaacatggatacaacaccattggtcttccaggaacaatcgataatgatattcctttcactgacttcactattggttttgatacagcgttaaacactgcagttgacgcgattgataaaattcgcgatactgctaagagtcatcaacgggtctttgctgtccaagttatgggccgcaatgctgctgatattgctctttgggctggtgttgcttcaggagcagatgcggttatcgcacctggttttgattatgacgttgaagcaattgccaacaagttgaaaaagaaccgtgcaaacggtaaggactacggaattattgtcatcgctgaaggtgatgctaattcagatgcagctcctgaattcattgaccagcttaagcaatacggcgattttgatgcacgtgctactgtaattggacatgtccaacgtggtggtgttccaagtgctaaagatcgcgttttagcaagtaagatgggtgcttacgctgttgagctactccttgaaggtaggggtggtttagcagttggaatcttagaaaataaggttcaagctcataacatgcttgacttgtttgatgcaaaacatcaagcagatgattcactttaccaattaagtgaagatttatcattctagagttctattaatatttggataaaatgacttaagaagtcttttataatttaaaatcaagggagagattctgtaatgaagaaaaccaaaatcgtttcaacacttggtcctgcaagtacttctgttgacacaattgttaaattaattgaagccggtgctaatgtattccgctttaacttttcacatggtgaccatgaagaacatctaggtcgttataacatggttaaagaagcagaaaagattactggcaagtcagtaggtattttgcttgatacaaagggtgctgaaatccgtacaactccacaaaaagatggtaaccaagaatatcacacaaatgataaggttcgcatctcaatggatgacactttggaaacaacaaaagaaaagattgctgttacatatgatggactttttgatgacgttcatgttggtggacacgttctttttgatgatggacttcttgattttaagattgacgaaaaagatgaagaaaaccgcgaattagttgctcatgcaactaacaatggtgttcttggatcacgtaagggtacaaatgctcctggtgtttcaattaacttacctggtattactgaaaaagatgctgatgatattcgttttggtcttgaatcaatgaacatcaacttcatcgctgcaagtttcgtacgtaagccacaagacgttcttgaaattcgtgaattgttggaagaaaagaacatggaagatgttcaaattttccctaagatcgaatcacaagaaggtatcgacaacacagacgaaatcttgaaagtttcagatggtattatgattgctcgtggtgacatgggtgttgaaattccagctgaaaatgttcctttggtacaaaagacattgatcaagaagtgtaatgcagttggtttgcctgttatcacagcaactcaaatgcttgactcaatgatcgaaaacccacgtccaacacgtgctgaagcttctgacgttgctaatgctgtttgggatggtacagatgctactatgctttctggtgaaagtgctaatggtgactaccctgttgaagctgttgctacaatggctaagattgacgaaaaagctgaaaatgctatggctgaagacggaaatcttcaaatcaacacatttgatcaaagtgatgttacagaaacaattagtgctgctgttgctcgtgctgctaagaaccttggtgttaagactatcgttgctgcaacacaatcaggttacacagctcgtatgatttctaagtatcgtccagatgctgacattcttgcaatcacattcgacgaacgtgttcgtcgcggtttgatggttaactggggtgtacacccaatcatcgctgaccgtccatcaacaactgatgaaatgtttgaactagctgctaacaaagctgtagatcttggtcttgctaaagaaggagacttgattcttgttgttgctggtgttccagttggcgaaagtggaacaacaaacatcatgaagttacaactaattggttcaaagcttgcttctggccaaggtgttggtgatgaaacagttattggtaaagcagttgttgctacatcagctgatgaagctaacaaaaaagctgttgaaggcggagtacttgttacaaagacaactgacaaagactatctaccagcaattgaaaaatcaagtgctttagtagttgaaaatggtggtttgacatcacacgctgcagtagttggtatttcaatgggaattcctgttattgttggtgtacaaaacgcaacttcaatcctttcagatgatgaattgattacagttgactcacgtcgtggtattatctaccatggtgcatcaaactcactataaaaatttaatttaaatttttaaaccccagaacatataatgttctggggttttttgtttggcagaatgaaagttgaatttagactgttagggttctagatttaactaaaaaagggatactactaatttaaaaaatcgtaaatcactagctaactagctactattcctgtattcacatcccttggaggtgttattttcatcgctcttaagcccatatatattgaaaataaaaaagattgagccaaaattgactcaatcttttttatactattattttactcgagctaagaaatacttcttctttccccgacgtacaattacaaacttaccatcaaagttacttgcagggtcaatttcggcattgacgtctgttactttttctccgttaattcgaatagctccattttgaatgtcttcccgagcttggcgccgtgatgattcaatcttagtggtatcaactaaccaaagtacaatgttttctttcttattttcaacatcaacacttggcatattcttaaagccttgttcaatttcactagcagttaaatcttttacttcacctgagaataaagctgctgaaatatgttgtgcttcttcaaccgctgcatccccgtgcacaaatgaagtaacttcttctgccaaacgacgttgtgcttctcgtttttctggagctgttttaactgtttcagccaaacgttcaatttcttcatgacttaagaatgtaaagtacttcaagaatttaactacatcccgatcatcttgattcaaccagaattggtagaattcataaggagtggtcttttcagcatctagccaaacgttaccaccctcggacttaccaaacttggttccgtcagctttcaataacaatggaatagttaaaccataaacctttgcttcttgaccttccattcggtgaattaaatctgtaccagctgtaatattaccccattgatctcctccaccgatttgaagttgaacatcttcattcttatatagatgtaaaaagtcaattgattgtagaatttggtatgtaaattctgtaaatgaaataccaacttccaaacgacttgctacgatatccttagctaacatcgtattaacgttaaataacttaccgtaatcacgtaaaaagtctaacaaggacattttagaaagccaatcataattgttaaccattcggaaattatcggttccaaagaatttcaccatttgagacttcaaggcttcttcattatggtgaacctgttccatggtttgtagaactcgttctgcttttttacctgatggatcaccaatcgatccagtcccaccaccaattaaaataactggtttatgacctgcttgttggaatctcttcaaaaccatgaaaggaattaaatgcccaatatgcatactatcacccgttggatcaataccagcataaagcccaatcttcttttcgtctgttaactttttcaagccttcttcgtctgtttgttggttaaccgcaccacgccaagtaagttcatcaataatattcattttcattcctccaattttatcgaccatcttcaattagaaataaaaacgtccccaatcttaaaaaattaagatcagggacgaatttttccgcgttaccaccttgattgagtatcaatactccgctcaacatcgataacgagatgatccgttcattaaatgaaagctccatagtgtaattcgcgtcattaacaagtctgattcgcatccccaccagatttctgtttgcttgcttaataacctactatgctacttcaaagcttcgttattggttacaattttacggatattcaaaacgactgtcaaccttatttagctaactcataaattgcatgggcgtagataacagcagcgttgataatatcatcaatttccatgtattcattagcttgatgcatgacattttcacggccagggaactgtgccccaaaggcaacaccacgatctaaaattcgaccgtaagttccaccaccaatgaccgtttcctcacccttttcaccagtatgttcttcgtaaactgaaagaagtgttttaaccaatgggtcttcaccggatacataatgtggtacttgggcgtgtccatgaatttcaacttttgcttcaaaatccgaaagggcctcagttgccttttcgataatttcatccgcattcgttgattgagggtaacgaacgttaataataacgtgattagtcttaccgaattcgtaattaaataagtccggtgtgaccgttaagtcacccatcttagcatcaatcgaattgattcctaacttatgaccacgtgaatctaaatgcatttgttcggcaatcatcttcaaatagttgttggccatcttagtatttaagaaagttgctaaaaaggtagcagcattcaatcctgctttcggttctagcgcatgtgctgattttccaatcaagaaaaatttcaattcatttccatcaacggtaagttctcccgtcaatccattttcagctaaaaatgtatcaaattcggttttaagttcttcaacgtcaacattatcagcaattacgattgctgttgcatcccgtggaatcatattttctttaataccactagtaaatgatttcaaaactaaatcgccttgtccatctgattgaggaagttcaatcttgaaggaagcaatccctttttcaccattaataattgggaattcagcatctggagaaaaaccaaaatcaggagttttttcaacttcaagataacgattcataccaacccattcgctctcttcatcggttccaaagattaaacgaatttttttagaaacgggcaacttcaattctttaatgatttgtaatgctaaataagcagccattgaagggcccttatcatcactaattccacgtgcataaattcgtccatttttttctactggttcaaatgggttagtttcccaaccttccccagcgggcacttcgtccatatgaccgagaattccgaaaatttcttcgccctctccgtattcaatatgacctgcaacgttatcgatgttcttcgttacaaatccatcttctttggcaaaagccaacatcgtttccaaagctttacgaggaccaggtccaagtggagcatctttggttgcatgttctgtatcacgtgagctgtcaatcttaagcaattccattaagcgttctaacataacgtctttacgactttgtacttcagcattccaatcaattgtcatctgggataccacctttatttttattcatatacattttttctatacggtagattatacagaaaaaagataaggatgtggagttccaccttttagaaggttaaagatttttcacatacttatcttcatttttgttactttttttgtttaataccagctcggcttatcaccatctgtattgggcttattaacaccgatggaatgcttcaactcggtattattttgaataagttccaccacgatgtgagcgatactcttccgagaaacttcagttcctttgaagacctcgcccttttgagtaacttcgaaatcaacttcgtcgttgttagttaaccaagctggacgaacgatcgtatagtccagatcactgtcctcaatcacatcagcggcagcccgataattggttatgtaactccccaatgttgaattattccattcaccaaacttaccaggtacctcatcgtaaattccaagggtagaaatccagactaatcttttaatcccgaccttatccatcgcttttaccaccgcttgggcctgttgtttaatatcgccaccagctaaattagcgtaaaccgcatcgactccctgcatagctgcgactaattgttctaagttagttgcgtcaccttcgattacggtttctcgatcaggttgaactggatttaaacgactagctttgcgtaaaaatagctttaaactatcatccgttttttccaaaaattccttttctgccaaacgagcgatttttccatgagcacctaaaatcaaaactttttttgtcataattatctacctccactatccattctacttgcttacaaaaaattagcaattataaacacttttacgtttaggtaataattttcaatatttttagctacaccttttttaatgaaaagcgacaaaaacttgccaaagggttactactgtacaaattgcaatcacgattaaatcaccaagaatggtttccatttccattactgcaaatttctctacatcttcgcttactttatcaactcgacgacgagttctgatggaaatccagcagaagtaggccacgattaaacaacaaaatggaactaaaaacaaaacatttttattcaccattccagctgaacttcctagagctgctggcacctcattttgtagcattggtgaagcgataaaggcaattagcaatggtaaaaacgcaatccactgaatccatttaaaccgtgataacgcaattccctgtaaccatgttggtaaattatcaatcgtcaatgtgggttttcttgaatctgcaatcactgcttgggctttttctgatttttgcgccgctgttaatttattttttcttttactcatatttaattcccctatctcttctcaatctacatttagcatagcagttccttggataaataaaaaatgcgggaaatgagcttaattaaactcattggccacatttttatttttagtgatcggcttatttgttggccatttgagcacgtttttcagcttcttgctgaagtgcttggcggtcagcaatcttgaagaatggatagtagattgctccaccgattgctaagttaactaattgaataactgcaccggaaatcttaccagttgcaaggtatccagaaatcaaaggtggagttgtccaaggaacagcaacaccaagtggtttaccaacccaaccgaacttcattgcgtagtaagtcgtgataactgaaatcaatggaacaatcacgaatggaatcgcaataaccgggttcaaaacaattgggaaaccaaagataattggttcgttaatattgaataatcctggaacaccagctaatttaccaatagctgataagttttctgatttagccaagaacattaacatcaaagcaagtgataatgtttcaccggcaccaccaaagtgaacaaagttatcaaagaattgttgtgtggcgatgtttggaatagccttatgtgctttaacagcatcagcattttcagtcatctttcctaaccaaattggagccatgattccaccaacgatgtttgaaccatggataccaaataaccaaaggaatacaacgaagaattcagcaactagagcaccgaagattgatccaccaacgacgttcaaaggttgagcaacgattactgtaataacatttggaatcgtcttaaagtccgtgaagctaacacctaaacgaagtaaccacatacctaaaataataacaaaacctggaattaatgatgaaaatgcatgtcctacagcaggtggaactgtgtctggcatcttaaattgccaatttttatgaatcatccaaacgaatgcatcagtaatgaataacccgattagaagagcttcaaagagtcccattgaacctaactgtgttagtggtacccatgctgctcctgccttatctatattcaatggaatcgttaacataaatgaagctaaggaaaccatacttgcagaaagagcatcgattccttcatatgatttagctaattcatacgaaataccgattacagctaccattccgatcacactaaatgtagcattagtagcccagccaaccgtagtttgccaatctgcaccaaacaaacttgacatcaagtttagatatgcggggattgggaactgactaataatcatgaatactgatccaataatgatcagtggcattactagcgcaaaaccatcacgcaaagcaaccaagtgacgagatgaagcaacttttccggcaattggcattagcttttcagcaaatgcattagtcttattgttgtcactcataaataaaacctccctaaatttttattgatcagcaattacaatctgaattagtaaataattgatatgaccttaaaattactttcccaaaatattggaatcgctttcacaaatacataataacatttgtacctacaaattaaaaccgttaacacctaatttggaatttgttttttattatacataaaaaagttatggttaaaagctggtagccctattattcaagaccttgatatccgactcttgttccataactttcttattttttctatttggtttcgagcatcttgaagtcactccaaggctgtaagctgtctaaaatcatagcatcttctttagcaacatgacctacaacattaactcgaccattattttctaaatcttgcaaagcaatttgtgtttcagctttgtactgggcatactcattattcatcactaacacgtcgccttttttaattggaacaggattgttagcaggcacatcttcatcacgataccaaacgcgggtcattgtgctacgtaaaacgtaatccgaatgatcgccacgatatgagtgttggctttcaaaaacaattttatgttctaactctgtcattgaaggagctggaatcacatgaaaagctggcatactcattttaaatgcttcggaagcggcttttaaatcttcttcagtaacaccagcattagaaattaagacatcatcaatcaatcctagcatcttcaaatgcataatttgtgtgaagagggtttgtccacgatgttcttccagtgaaaccatttcttcttggagtggccaaggaccgatattaccagaaggggcattaacaaaagcggcggtatttaaattatgcttccgatattgttcagaggtttgtttgaaatagtccaaccctaatcctgtatatctttgaggataaaaattatgtgaaccaatcaaattatcccggtttggtgagtaatccatgatttgatcaatatagtacgttccacgactcatattaacttcaatttttaaatcataaggattatgcgtcattcgagcctcttccatccccgtaaatccttcatccagtcgaatggcccatgccccaatatcatggaaaaatttgaggttatcgtaggatacccctaactgttcaaacaaacgtggattgatatctaccatcgtgtccattcctaatgaatttccatattcaatcatatctttgaattggttcacgaccttttcttgatcacccttgatttgtagtagtgatgtaaaaatccgtttaaaaccatatttacttgctaatttaatatattttttggtttcctccacgcctacccggtctggatagattgaaatacctagtcttcccattaaaatttcctcctatttcattggtatacaccaataatgtattcgctttcagtatatcatctatgactaaaaatttcagctatattctgtttttcacttgtaaccgagtttgacgagtgaaccagcaccgtgatactctttttcataacctatactaaggacagtgaatagcacgatgacaaaattaattaattttttagccgagtatcagcgcgaaatcgaaagtcagcccatcgaattagacttagctttatttagtcgtttggtcggactcccctttgaagccgtactaactcagccttctgcccctttagtggaagcttgcatgaaattaattgaatttgtagataatgaaaattacttgattttacctgctgatcgccaaatgttagaacaaattgcttttagcaatcgatatcaaagtgttcaaatatgcgatgtggtccaaggaccacaccgctttttagcggctacttttgttctttcaaaaaccactaaagtcattgcttttagaggccctaacggaaccttattaagttggaaagctgacctccatttttcattttcttccataaataagttaaaaagccaagcacaccaatatctcctccaagccctacagcacgataatcaaaatatctattgtgttggcttttctcaaggagcttccattgctgctctagcttgcatggatatttctgatacccatcgtcatcgaattcaaaccattatctttgacagtcccggattacctgatgaccattatcaaagtccaattcctattattgaattagttccaccgttgtcgttattcgcactagttggagaacacccttttcaccaaattaccattagcagctcttcaacagggatttggcagcacgatctttattcttgggaggcagattcacatggagcatttgctaaaaacattggaattaccaatcccacgactattcaacaccaatttattcaattattaccaagcaatattactgacgaaaatattgaccgtaccttgaatgttgctatcagtatttttagccaattaaatttccattccacttccgaacttattaaacattggaatcagtttaatgctctaattcaaactgaaatcacggtcgaaaatattgtagttaaaactgctattcttcgtctccaaaaattgatttttaaaaatgccgctttgaatctccagtcaattccattaaattaagtttcttaaattatggtatccttgaatcaaccatttatgaggagtgtgaatttaatgtcaaatgaatttccacaagctttaactatcgctggttctgattcagatggaagtgctggaatggaagcagatatgaacacattccaacgtcgtaacgttcatggaatgtgtgtcatgactgcctgcgtagccggtaactcttacggtattcaagcaagccacgccctacccaccgattttgttgatcaagaatttcaatctcttgcagctgattttaaaatccgtgctagtaaaactggcatgcttgctgacagtcccatgattgaaacagtcgttaaaaactatcaaaaatttgattttggaccactagtcttagatcccgtaattattaccaagcatggtgccttgttacttgaagaagaagctttcgaaactttaaagcaacaactcattccattggcaactgtgattactcctaatttttatgaagcaatcaaacttactggtattgatattaaaaatgacgatgataccatccaagctgctcatatcctacaggaaatgggtgctaaaaatgtgatgttgaagggttcgcacaaaccgggtgaacaaaccgaagttcgtgacttcgttctcttggaagatggctccagtttttggcttagtgaaccatacattgaaactgaccgggttaacggtactggcgatgtcctttcagcatgtatcactgctgaaatcgctaagggaactgatattccaactgctatccgtattgctaaaaaatttgttaccgctgcaattgccaacccaatcgcagtaggtcataagtatggacccgttaatcatttagcgaaattccaagcttaatccatttaaattaaaaacgcgaaacaaatttaagggtcaaggcccgcaacttgtttcgcgttttttatattagttttccgtatctttttcagtaacagtctgcactgccacatcattggcaccattatcagcagccgcatcggaatccgtagtggtagaattggcagttgaattattagccgtcgaattagcattcgaagtggtatttccagcattagccggagcgtagttactgccacctgtattacccgcagttccagtagttgctgccccaccagctggggtgttgttagcagcatccgtagtggtatcgactcccgtagtatctgcactttggtccgttgattgagtatctacactactttcttcactggaagatgattcatccatactaactgcatcagcatctgtagatgtcgatgcactattagccgcccactctgtatacgcgtctgaattattaataatagtaactttaattgttgaactagctgtatgcccactagccgttgatccaatttcaaattgaatcgacttaactttcttacctaaatgaacattgtaaactactttaccttcagcatctgccttggcaacttcggtttttcgtgtctttaaattggtaattttaacttctgccttggcattagttttaatattaattaaagcattacccaaagcattggttttctctttttttgtatctacttttaatttagttgctgttttttggacagtatcctctttagttgttgtttctggcttagcattctttccacaagctgctagcaaaaataaggtcattattgaaactaaaattgtactaatctttttcaaagcttcatcctccaccacttcggttattaactttaattattacagtgtatttatcatcggtcaaacagaatttttcaaaatgcttgcaattgttttaaaatatccctatacttaagttactaataaaaagtaagcaactttaaaggggattttaaatatgtcaaattcattcttagatgcaattaaaaaacgtcgttcaatttacgctcttggtaaaaatgtttcactcagtgaagatgaaattactgatttaattaaagaagctatccgtcaaagtccttcagcttttaacagtcaaacggtccgcgccgtaatcctattcggtaaggcccatgatgaactatgggatggcattctagacattcttcatggtgaggttccgaacgaagaggctttccaagcttccaaagccaaggtggaaggagcttttaaggctggagttggtacagtattattctatactgatgaaaaagttatcgaggaccttaaaactaacttcccattgtataaggatgctttcgacatgtttggtgaacacggaatgggaattgccaacatggatgtttggacaacgcttgctaatgaaggcattggggcatccttacaacattacaatccaattgctgacaagttcatcgctgataaatttgatattccagctaactggacccttaaagcccaaatgccatttggttcaattgaacaacccgccggtgacaaagaattcatgaatgacgaagatcgttttcgcgttattaaataattaaaaagtacaaaaaataagctgtggtaaaagttaaaaactttccacagcttatttttattttaagatagcatgccacttttgataaacttcatcgaaacggtactcctgagctttagcgtaagcaccttggcttaattgagcccagagaacatcgtcacttaagatttttcgaattcggcgcgccatctgtgcataatccccgttagtaacaatatacccattcttatctttttcaattaaactatgcaatccatacttagtatcaaaagataccactggaacgccgtgcgccatcgcttcaatcaggttcataccggcagcttcactaaccgaagtattgactataacttgcgcacgattataaaatgattgaatttcattatccgtaagataattaccaaagataacctgagcttgaactccacgttgttcaactaaatttttcatttcatttaacagattttggtcgttagtatatcccctaaattccaacgaagcgtcaggaaactgttcgagcaccttaaagaaggcttttaatgcttccattggtcgtttatcagcttctagtcgaccactaaaaataattcgtcccacaattcggtcccgtaaccaaaccggtttggaattgattaattcgggactaatcgccacatcgggggcgacttgaacgtttaactcaggaaactgctctttaagttccaactgttgttcttgtgtaggaacaataatcccatcaaaatcttgagcccggatttggagggcaattgaatatgcagcaaaaggagttccaccttgatccacgtgtgaaccatgcaaagcaacccatttagaggtagcattttctacatcagcaatcacatagtcaagctcacggtgatcggataccactacattatcggtcgtttgttgggtaacttcatttaagaaaaatagaaataactgatcttccgtgtcaaatcgataattctttccatgataattaactaatttccacatcgtaggctgtaattgcccttcaacattcatgtaggtattttcaagaaccacttcgcctgccaaattcaaaaaacgccgtacgcccagggagccatcggggtgaaagtaatcaattgaagacttaaatccgcgccaatcaaagttttctcgactaacaacggtttcaaagcgatcataatattcgatatcacccactaaaccgaccgttccaggcataatattaattcgagctaattggcgaccggcatggtcgaccgttgagtagtcagctccatgttcgaccaattgatattcatttaatgccagttgcttaaattcgcgaactggtaattgaacgcgctctaccgcactagttccctgaaagaaatcatacatattcaaaacattggttgaatttaagttaactcgctcagcatccctaacccataagcgattataatctctagtaacataccgagcctggtcgccactggcgttaaatagcagggtacgattggcttgcgagtgttccactccagaattaaaagtgtaaatactacgactaacaaaatatttcattacttacggacctccccacgatattctggcatcgccttcaacttatctggccaacaattttcagcatcttgcaacaattcttcccacgcgtgccaaacattttcatccgagtaacgctcagctgaatcgtaggctccggttgaatatttctgggctaattgtgggtcttttagcactttaatcatggcttgagcgagggcttcataatctccataaggaaccaccttaccatttacaccatcttctacaatttcatttggtccataattaacatcgtatgagaatgaaatcaatccatgagcaatgccttccattaccgccaaattaaatccttccattcgagaagttagaccaaacatcattgcgttattttcaactttatcaatatcggtagtgtaacccttcaatttgactacgtcttctaattgattggcttcgataacctcttctactaatcgtcgagcctcgtaattattagaaccatccgcatagccgtaaagatctaaggtaacttcagggactacctggtgaaccaatgcgacggctcggaccaaatcatctagatgtttttcccaagcaatccgcgcaaatgcaacaattttaccaaattggcgttctttaaccgcaactcgtttactgtttaacagttgttctggaacaatcccaactggaatagtgaataaatgtgttttgggttggaaacgagcccgtacatcttgggtctgctttttggtagcgctgataaatgcgtcataacgatccattgatttcaaggcaaactcatagtgttggtttaaagttgaatgcattggattttgagcatcagttgcatgcgaattgtgcaaatgaatcacccgataggcgggtttttccatatttaagagcgcccaatcacctaaatgatcccgatctaaaatatagatattaggttgcgtttctgaccaaaagtcattatttaaatcatcaaaaaaatgttttgtcagctcttcgattgtgtcaaattgataaacttttccagcttgcgttgttaatttccaggctgattgtttcatctcgccttgcgcattttttctggtgaaagcctcaatcgctactcgaccttctggtgttttccattcttcagtcccaatttgattatcgggggtataccactgactaagcgagataaaaccacgactatcataatgatcaactcggtaaagattgccaaatccatcaaagagttcagttgataacacatgatcatctttaatatcaacattgattctggcaactaattgaccatcaatggtttccgctaaataacgctggtgatcaaaatctgaactaaatttcagattttcaactcctaaatctaaatctggaggcgtgacaatcttatcttcaacgtgcatcgcctgctggtagtaatcaaacatgctaattacatgttcatcatcgattcctgctaaggcggtaagtcgatgagtttctggactccaatctcgcaaaacaatacgagcctctcggtgcattttattaaagagcttaaggcgctttaactgcgcgtgttcaattccggacttcttttctggcatttgtgcattaataaaaaatatcatttttcatttcctcgtgtttccacctgatttttccgttaattattagtccattatagtataatttagcttcttatttgtgaaatcaaagttaagaattaagctaaaaaaaacgaattaaaagtatcatcttttaattcgttttttaatttaaatttatttccgactcattctagtagcaattcgttcaccagtaagagtaactactgaaccaattaaaataataataattccaacaatcgtgttggtatgaattggatcacctaaaacaattagggataggattggagccagcgctggtttgataaagaaaatcaaagaagcaatagggacccccgcttcttccattacaaggaagtataaaccgaatcccaatccggttacaaaaaaacttatgtaggcaactaatagaatattagaccaggtgattccttggaaaaatggaacatcactgaaaccttgtaatccgctaagggcttgactgacagctggaatgtgagtaattgccatgaaaattcccaactcaatcgcacctgcaataaacgaaaaacacgtcattgtcattccgccaaagcctagcttattcgaacttaatcgagttaagatgccataaatggcgaaggtgattgaacttaaaagtcccagtgtaattcccattgggttagttaaattaaatggattaacaattacaagtaagcccgctaaagttaaaataacggccaacgtattagtccgtgacattttctctttcagtaaaactagtccgattaacatcccaaaggctgggttggcactcaacagaatcgcaatcgtggccggcaaggacatctgaattgctaattgatacaaggtcatactaaccaacacgcacgaaaatccagttaatgaaaaggctgcaacatctcgtcctgttaaatgacgttgttcccttcttaatcgctgtaatgtaaaaggtagtaacaacaagccgcccaagaggaaacgcacaaaatttaattggatgggattgaaagttcctcccgcaattttaagcgcaatctccattgaactgaataaaaacgtggacatgatcacgtagatcagagttcgtaacttcaatgacaaaacttctttctcttttagaattaactcatctaccatcttaccactttatttttagcattctttgaaacaaaaaaagctgtagccaagaccaccgatatggtttactttgctacaactcatcattattttaccaagaagcttttctaactcctggaatctggccttcatgtgctagtcttctaaagtttagacgcgacattccaaacttccgcatgtaggcgtgtggccttccgtctaggctgtcacgccgatgcatcctagttggagaagcattacgaggaagctgacttagagctcggtaatctttattcgccttaagttcacgacgcaactctgcatatctagctaccgtttcttcaattttttgttctttaataatcttagatgtttttgccaattttctacctacccttactttttgttagttaacagattatagctctttacttacttaaagtaaaacaaaaacattcatcataaagctaactgtaatcggtttcattgtgataaaatcaattataagaagacataggagggattgtattttgaagattaataaagaagagttccaaaacgtaaattggtacacgctttctaatgacaaccatgtttctgttaccatcagtaccctaggagctacggtagttgctgtaaatacccctgataaaaaagggaatgtcgaaaatattgtcttaggctttgataatccccaaacttatccaaagcacaacgattattttggtgcttcagttgcgcgggttgccggccggattaaagatggtaagtggcgcgattaccaattaaatcaaaatgaaggtcaaaatactttacacggaggtaataagccttcacttagctacgttaattggaagaaaattagtaaatttatccgcccagaagaagtcggtttagttcttaaacgttttagtattgacggtgaaaatggctttcctggcgatttaaccatcgatgctattttccgtttaaataaccgaaatgaattttcgataacttatatcggtcacgcttctaaacaaaccctcttcaaccccactaatcatatgtactttaatcttagcggggacgctaagcgttcaattaagcaacatcaaattgaattaaaaagcgatgtaatcgcagaagttgatgcagagttaattcccactggtaatttattaaacgtggatggcacaccgtatgacttgcaccatccaacttcaatgcaatccatccttgatcaagtatcagacggattagacactgctttcaaagttgaacctagcatcgaagcacctcaacttacgctggaagatcctgaatctggtcgtaagatacgggttcaaacttctgccaatgcctttaccctctttactactaatgagccacaagagccattcaaaattaatggcaatcaagatatggcagccaacatcggattagcaatcgaacctcaaatgcttcccgatgccatccaccattccggcttcggtaatatcattatttctccatctaaaccgatgatgtatcggaacgtttactatttaaactaacaattttttgaaaaaggttctgtaatcagcttatagtttgattgcaggacctttttatgataatttaggtgagttattaatgcacctcaacacaattatgactaaatcaataacattgggggctctgctatgtttataattggtatttcgataattatttttttgatttccggaacttatttatatttagatcgtcgagattttattgcggggattgtttttgctggtagttgcattaacttagctttattatccactttgtggattgctaattatctggcaggaggttcaagaactggaattattagccttgcggtcttcctacttttaggaattgttttgacgccgttagtaatcggcttcagtttgattgttaacacctacattatgcaaactcgcgaaggcaaaagtttaactgccaaattatcgcttattttaggccttaattttttattcatgttagttgctggtttagctattttgtttttgaatcaatttttaggacgcttcgttggaattttgcttacccttttagggattgatgtaactttaactttcatttttgtttgttatctcttttattcatttctttatcaagtggttcctatcaaaggcaacgtggattatattattgttttaggagcgggggtacgatctgaaaccgtaactccactcttaaaaggacgcttggataaagccctcgaatattatcgaagacaaaatggcgctgtgaaaattgtggtaagtggcggacaaggacctgatgaacccgtctcagaagcttttgccatggctaagtacttgagaaaccaatccgtacctgaagacaaaattattttagaagaccaatctactactactttcgaaaatatgcagttttccaagcagaaaattgaagccgattggcagggaacccaaccgcctcaaattatttttgctactaataattaccacgtcttacgtggcgtaatctatgcgcgtaaagctggcttaaatgctaacggtgtaggatcaccaacctcattctactttttacctagtgctttaatccgtgaatacattgcactattagttatctataaaaaattaactgctttaattttactaggttggatagccttgggaattttattaatgctctaaaaactaggaggtttacttatgcgaaaaggaatgattatcagtggcgtggtcgtcgtaattcttttaattacttttggaagcgcctatttctggtataactctaactatggtactcaggattactacactcaaatcgtcgataaaggcactaaatttgtggaaaaagatgattccaatcgtagttatgtgaattatgcttaccaccaacctgcttataaccaagctggtcaaaagataacggttaaatttaacggaaacctagaacgtccattaaagctccacgcatatttgaaaattggctacaatgcgaaacgaaatcaagttatttcttggagtaaagttgataaaaaagacgtccccaaggcagccttgaaacaaattaatccttaatttcttcaaagcactttaacgttagcttttttcaaaaatgtgccttaaaatatgggtagaggtgatgaataatgacacgaaaaattggaatcattggtatgggtcacgttggtcaagcagtcgctcaacaaattatcacaaacggctacgctgacgacctagttttaatagataaaaatgaagcaaaggttggtgctgatgcacttgattttgaagatgcaatgcccaatttaaccagtcacacaaacattatcgtaaatgattatcgtgccctcaaagatgcagacgtaattatttctgctttgggtaagattgctttaactgataaccctgataatgaccgttttgctgaacttccgcacaaccgtgaacaagttcaggcggtcgctgaagccatcaaggcgtctggatttaatggtattttaattccaattactaatccggtagatgtaattaccgcactttaccaagaagccaccgacttacctaaagcgcatgtgattggaactggtactctacttgattcagcccgcatgaagcgcgccgtcggcaaagggttaggcgttgaccctcgctcggtatctggatataacctcggcgaacatggtaactcacaatttaccgcttggtctacagttacggttcttgaccaaccaatcaaaaagttagctcaagctcggaatttagacttggatcaaatcaacgaagacgctcggatgggcggtcgctatgtaatggttggtaaacactatactaactatggggttgctgccgctgccgttcgtttggctaatgtagttttaaatgatgctcatgaagttcttcccgtttccaattatcgtgaagaatatggtacttatctttcatatccggctgtggtcggacgtgacggtattttagaacagcttcaactcgaacttaccgatgaagagcgctacaagttacgtcgttcagccgacttcatcaccgaaaaaatcaaagaatctaagtaaaaaataaaaaaacttcaatctttgcttaattgcgattgaagtttttttattttcgtcttactttttgtacttattttcacatgaagaaaagatgcctaattgaatgtcaaattcgaggcaccttccattcatttcgtcagctttttattggatttttaagaatgcatcggcaatattaaagcttggatcacatttcacttccacttgatctcccaaatcgtggatttgaaatttaatccattggtcccccactaaggcctcaccattgcgagcttgtagcactgacaatactaaatcatcaccgccttttaaaataccgcgtactgtattatcgccacgcatcacgttagtaactcctaatactaaatcgggtgtttctacttcactatgtccaagtctaactttataaatcggcactactacactcataataagcatcctcccatcaacctaaaaattacttgcattaattacctcgaattatatcggcttgagtaagctttagcaaacattctgctcaacttataatatatattgcttattactttacttttttgattacacgcttatataatgtgaccacaaactaagaaaaggggtgcaataatttgaaaaatatcaatgttttattagctgccgacgaaaattatgccgaccaactacaaatcaccataaaaacaacacttggaaacctaaacaaaaaaacacgtgttaattttattgtgctatctaataaccttagtaattctactaagctagctttgaaaaaacttgcacacgggttgcacacggttgagtactttgatttggatccatcggtctttgctttttgtcctaccaacagccatattaacaaaactgcatattaccgaattttggctccccaattactagcaaagcgcaatatcgatcgaattctctacttagatgttgacttattggttcgccacgatttaactgaattatacgatgcagaattgaaccataacattgtgggtgcggtgatcgataccggccaagcttttgctcttaatcgtctaggagtcgacccagtagttgctgcaaataatatctatttcaactctggaattttagtgattgatattaaaaagtggaatgaaaaccacattaccgaaaaaactttaaattacattaaacatcaatcacatctcattattttccatgatcaggacgccttaaatgccgttctcgcgggccatgttcaaatgctacatcctaaatggaacttacaaaattcgattgtcttcagaaaacaccgtccaattaacgaagcctacgatcaattgatcaacgaagccatcaaaaatccggcaatcgtccattttacaacacatgaaaaaccttggaaaacgcttagtgaacatccttatttggatgaataccacgaagaacttaacgaattagaaatcaatcgtggcgtggttaatgttatttctgccgctaattcagcttttgtggaagctttagcaacttcttatatttcaattttggagaatgactcagaaaatcaatacaatttctaccttctccccgatcatctagatcaacgtgatatgttaattttaggaagtgtaatttcacgttacgataacgcttcaattaaaatcgttaaagttgatgaaaagctactagaaaatgcggttgaaagtgatcgcatcctaaaatctgcctattatcgaatcttagcaccagaattattgccaaatattaatcgtgccatttaccttgattgcgatattatcgctaacaccaatctacatgatttatggcaaacctccctggaaggcaacgttctagccgctgtagaagatgctggtttccatgatcgattagaacacatgggtatcacgcatgataatagtaaatatttcaactctggcatgatgttaattgacctagttagctggcgttcccaagcagttactcaacgcgtcttagactatattaaccatcatccagaaaaactacgtttccatgatcaagatgcgctaaacgcgattttatacgacaagtggttacacttacatccaaaatggaatgcccaatctaacattgtgttagacgcgcttgttccaccacggactgaacttttgaaactttacgctgaaacacgtgaaaatccaaaattaattcatttctgtggtcacgtcaaaccttggcatgcagaaagtaaacacccttatactaatgtctacttgaagtacaacaagaaactacgtgaaccagtacggacttaatttttcataaataaaaggattgatatggaatcatctccataccaatccttttatgtcgttcaattaccatttcaaccttttacctacttcttatctttcttttctttcattagccgctgattagcccgttccccatctttaattttttgccgatactttcgtctccctaaatatgccttaatcacaaatggaatctggacaattacataaattataaaaatgatgagtacaattcgatacatttcatccctccgtcaaaatgatttggctgtactatactacaaaatccagtaaaaatcctttagttaaccttctttgtatagaattcccactttttttaactgttccttagctttttcgatattttccattttatccgctgctaaagtatgactgtggataccatcggttaattcagatagcaagtgccctttagcttcccgtacatgttgcataaattgtttgacatcattgctattttgcacacggatttgtcccactagctgtccgtaaagtgggtggtcaatcataacgtctttaatcgtcacctgttctttaacaattagttccatttctcgctctgcttgatcggggaaatgacgacaaacgatcatttcttcaaatcgatgatttttggcatattcatagcctctcgaagttgaaataatcggctccccttgcgcacgcaacaaagctatatccccaacaatagtttgtcggctaacctcaaattgtttagccaatgtgcctgctttgattggtgttttagtttctaatagttgatttttgatagctatttttcgattaattttcataagtcattgctccttgagtatattttatcagaaaatccccgttacaagtgtcaagacattaattttaaataaatcattgataaatattgttttatgttgtaatcttgtattcaactcagagtgtgtcttgacactaaaaaggagaatgatgattttgaatggaatttcaaactataaaaaattactagcagcttcgggggtagcctggctttttgatgccatggacgttggtatattatcttttgtaattgctgctttaacgtcagagtggcatttaactgaatcacaggttggtatgattggtagtatcagttcacttgggatggctgtaggcgctattttatttggagcactggccgaccgttacaatcgaaaaacaattttaattattagtttactaattttctcaatttttaacggtatttcagctttcaccactacctatgcggcttttgttatgattcgttttattgtcggttgtggattgggtggtgaactacctgttgcttcgactttaatctcggagagcgcccctgctcatgttcgaggacgggcagtggttctccttgaaagtttttgggctggcggttggttaatttcggctttaatctcttattttgtcattcccagttggggctggcggattgccgtgtttatcacttccttagcggcgctctatgccttggtgctccgttttagtattcgcgaagcagattcaaatcattcttttacacccaaagctcgcctagccttacgtttaaaaaatatttggagtcgtccctatgctaaagccacgttgatgctttggattgtttggtttatggttgtattctcgtattatgggatgtttctttggttgcctagcgtcatggtgatgaaggggtatagtattgttcacagttttggttatgtgttaatcatgactgtggcacaacttccgggttactttatggcagcttggttaattgagcgatgggggcgcaaatggactttgatggttttcttattcggtactgccgtcagtgccatcgcctttggttttgctcaagggctgatgatgttattgttagctggtattttactatccttctttaatcttggtgcttggggcgcactctatgcctattctccggagcaatatcctgaagaaattcgtggaacaggttccgggctagcagccggaattgggcgcatcggtggaatcgtaggccctcttttggtgggatttttaactgaaaaaggtgttgctttatcaactacttttataattttcttcatctccattatgatagctgtaattgcaatcggcttcctaggtaaagaaactatggaaaaataatttttatgagaaaatttttacgctatccctagctttaatgctcttctagtatcacttctatagcgccctaattggagaggtatttgccacaactccatcaaaagcgctaaaatagtgtctataaaattagaagagagaaggtattccattggaaaaagcagctttaatactagaaggcggcgctctcagatcattttttactagtgccgttttggattattttctcgaaaagcaaatggatttcgagtacatccatggagtttcagctggaaccatggccgctatgaattacatttcaaagcaaaaaagacgttccgctgatgtcaatctccattttcttcatgataaacgttatatcggctttaacaacctcattcgtaatggtggaatctttaacttagattttttgttttcacctgaatgttatgattacagcccctttgactataaagcttataatgaaagtaaacagatttttgaaattaccgctaccaacgtcttaactggtaaagccgatattttccgtaaaacggataccgatggtcaagaagaagccgtcaaagcttcagccagtatgccgttagtatctgatatccgggtcgttaatcaccagccatacttagatggcggaattgctgactcgattcctttcagacgagctcaggaattaggctgcgaaaagatcgtcgtggtcttgactcgcgacattagctaccgcaaaccggaaaatagtcgcgctatgaatcgtttagttaagtttagataccgtgattttccacgttttgtccaagcttttgcagatcgtccacaacaatataatcgttcattagcagaaatcgaacgcttagaacgtgaaggaaaaatctttgtaatccgtccccaagaacccgtttcagtatctcgggttgaacgtgatgataaaaagctcatggccctttacgaaaaaggaactgaagttattcaaaatcaatttgcagatttacagaaatatttagcacaataagtaaaaccctccgaaaaattaattttcagagggttttactttatttttcaacgattacttgttccatcacaacatctacgttagggcgatcttcgccattgcgttttaccttactaattgctttaacaacatccatcccttcgaacacttgtccgaagaccgtatgccgaccatctagccagggagttcctccttgacgatatgcttccacaatttcttcaggaaattctgccgctttaagttgtttaatcattcgcttaggaacattactgttagtaacgataaagaattgactaccattcgtatttgtaccggcgttagccatagatagggccccgtttaagttatagagcttatttgaaaattcatcttcaaacgttctgccatagatgctttcgccacccataccagttcccgtaggatcaccaccttgaatcataaaatctgggatcacccgatgaaaaataacgccgttgtagtagcccttctctgctaattcaataaagtttttaactgttttaggtaccaattcatcaaaaagttgaattttgatgtcaccttggttagttttaatagttacttttgtaccagttgcattttctaagtctaattgtggataagccatttattaattctcctgcttctttttttgggtcataaaccattctaatctatttgaaatataaaaacacgtctaaagtaacggattataaataaaggatttttaccacataccaatcacttttattcaaagtgatccaatcccaaccccgattacaatgtaaaccaaaaccacacccagaatggcattcatccgccaccaatctttttactttataaagcctgaaccaaatagaacggagacaggctctaaagtcatcttttttactcctctatttatcataattagtcatctcaatgggaaccacccactgatcaaattgctcagcggtaactttaccagattttagggcggcttctttcagcgtgatcccatctttttcagcctgttgagcaattttggcgctatcgtgatagccaatatgaggagataaggcggtaaccgtcatcaaggaatggttaactaattcttccatccgttctgcattaacttctaatccagcgatcatcaagtcggtaaaactacgaatcgtaccttctaatagagtggttgattccaagaaagagctgatgataactggtttataaacattcatttcaaaattgccctggcttgcagctaaatcaatcgcaacgtcattagccataacacgcactgccgccatggtaagggcctctgcttgagttggatttactttacctggcatgattgatgatccaggctcgtttgatggtagtttcaactcgccatatcctgcccgcggaccactacccaagaaacgaatatcattagcaattttcatcaaatcactcgccaaagttttaatcgctccgtgaaccacattcaaaccggagtgatgcgctagtccataaaatttgttagaatccgccgtgaattcaaagtggtagacttcgctcatctgagctgcaattatggacgaaaaatgcggagctgcatttaaacccgttccgaccgctgtaccccccattgccaattcacttagcgttgaattaagttcttctaagtattccaaatcatgttcaagggcgctcttccatccactaatttcttggccaaaagttagtggagtcgcatcctggaggtgagttcgtccaattttaaccacgttccaatattgcttttgtttttggtctaattgttcaattaaatgttgaactgcctcttccaaacgtactaccgctactgcagctgtaatattcatggccgttggtaaaatatcgtttgaactttgtccatggttaacatcatcattaggcaaaatttctatttccgcattaattttagcagccatatgggccaccacttcgtttacattcatgttagtttgcgttcccgaaccagtttgataaactaccagcggaaaatctttccgtaattcagcatcatccagtgctagcagacgatcaatagctactacaattaaatccgctttttcagcagccattgattgttcctttttattagcgatggctgccgcttttttaatctgtagaagagctttgataatttccaggggcatcttggcaccagtcgcaaagttatgacgacttctttcagtttgggctccccaaagtgcgtctactgggatttggacgggtccaagcgtatcttcttctgtacgatatttttccatattatgacctccgaaattaattgtctaaatcgcattcctactaatttgcttcgtttttattataaaggactcccgataaagcaccagtgaaatttaaaataaaaatacgactcacctaggattatccatcttaggtgaatcgtatttaataactaataattcttacaggtttaaacgagcttaaaatcttactaattaatggctgagataaaacgcgcaaatgcggcttcaccggcgtcatcccatttaaagactcctgcatcagctaaaactcgcgcaaaaacatttccaaccgcagcatttactacggcagtaacattttctgcggtaattgaatttgttgacttcaattgatccgcccaagcttgatgcattcctgccatttggttagtttgacccaataagtacttttctacttctaccaattctgtctttaaccgagctggtaaaatcgctcttcccattacttcgatcaaaccaatattttcttttttgatgtgttgaacatcttgatggggatggaaaataccatctggaaattcgtctgaggtttgattatcccggagtactacatccaaaacatagttttctccatccttgtacgcaatcggcgtcgtcgtatgatgacgagttccgtccgtgaacgctcttacatcaacactttcatcagaatagttcatccacgcatcatgaattttaacagcagcatctgtcaatgccaccacatcactaccaactaaccgaattgttgacattggccatttcacaattccagcttccacacctgctactcctaaatcaatcgttctagcaatgggagccttcatcattggaaatacatgacgtccgccttggtaatgttcgtgtgataacatcgaacctcctacaatgggtaagtcagcgttactccctacaaagtagtgcggtaactgtttaacaatttcaagtaaattggtaaacgtctgacgattaatcaccatggggcggtgaatttggtctaagaaaatagaatgttcattgaaatatgcgtatggtgaatattggaagccccaagtttcaccacccaaggtcatccgaataattcgatggttgctacgtgatgggtaacccaaacgtcctaaataaccttcattttgcatgcataattggcataatggataaccatcctgaggttgattacgagcagctgcaattgctttaggatctttttctggtttagaaagattaatggtaatttcaagttcaccaaaatcagtttccgctggaaaagatacattcttagcaatggcccgtgttttaatatagtcattagttttacttaaattaaagaaataatccgtcgctgctttagggctaacttgatacttatcccaaaaacgttgatttaaaatcgaaggtaatggcgtaactaaatccattaattgatctgccaaaatgcttcggtctgattgagcatcttcaattttaccgttttgaaccgcagttttaactaaggcatctactaagctagttacttgttcatcggtagcttcaaccggttgatcttcacccactaaacctaaaatccgattatgcacataaattcgatctaaattggtgtatggtgatggcgaatcgattacaacttggacaaattgttctaagctactcattaggcttgtcctcctcggtcatcgtatccagctggatggttgactttccaattccaagcagttttgataatttccttaacatcatcgtattgaggttgccaatctaaaatttcacgtgctttatcactcgctgcgattaaagtactagggtcgccagctcgtcttggtgccatgacagctggaatttcctttcctgtcacttcccgagcagcttctaacatttggcgattggagaagcctgttgaagatccgagattgaatgcgttactatcatgaccttgtttgagatattctagagctaaaatatgagcatcagccaaatcaacgacgtggacgtaatcgcgtacattagtaccatcagcagtaggatagtcatccccaaaaatttgcaactgatcccgttcaccagcagccacttgtaagataataggtactaagtgtgtttctggttgatgatcttccccaatactgccatctggtttggcaccagcaacgttaaagtagcgcaaagccacaaacttaatgccatcagccacatctgaccaatgcatgattttttccattgctaacttactttcaccatatggattagttggaacttgtggatcagattcttgaattggcacccgttctggttcgccataagtagccgctgtagatgaaaatacaatccgtttcacatcatgtttggccattacttcaagaagtttaaccatcccagcagtattattatcaaaatacttcaaaggatttttcattgattcagggaccacggaaaacgcagcaaaatgaattaccccttctacgttttctttggtgaagactgaatccataaattcaacatctcgtacatcgccttcgtaaaaacgagcttgctggtttacggccgcgcggtgtccagtaaccaagttatcaacaaccgctacatcgtaacctttcgtaattaatcgatcaactgcatgggagccgatataaccggcaccacctaaaactaagaccgccattctaattcctcctcaatctctcaatgcgtattactatttaaaaattttcactaatattaaagttctttaggtccatcagcaatttcagcaatatagaaatcagcatcataaccaattgtatcgcgataaactttaccaacattttccttgaaagcttcaacttggtctttttcaacaattgcgattccacaaccaccaaaaccagcaccagtcattcgagcacctaatacaccaggttgtttccaagctgtttcagctaaagtgtctaattccttgcccgttacttcataatcaaagtgtaatgaaacgtgtgaagcagtaactaattcaccaaaagttgttaagtcgtcatctgccaaagccttagttgccttgatggttctttgattttcaaaaacagcgtgacgtgcgcgtttaattaaagtttcatcattaattaagtaagctgcttcatcaaattcatcattggttaaatcacctaaagtcttgatgtctaacttagtttgtaaacgacgcaatgcttcttcacattcagaacgacgttcattatatttagaatctgcgagttcacgacgtttattagtattcataattacaatgacgtgattgcctaatttaaccggagcataagaataatcaagtgtgttagtatccagcaagattgcttgatctttcttacccattccgaccgcgaattggtccatgataccagagttaacaccgacatagttgttttcacacttctggccaatcttaactagatctaattgactaacgcctaaatcaaaggccgcgtttaaaactgctccggttaataattcaattgaagctgaagaagataagcccgcaccatctggcatatttccgtgaacgtagagatcgaagccatggtcaaacttaactcctgttttgactaattcattcatcattcctttaggataattagtccaacctgcagccttatcgtaatccaaagcattgacatcaaaactaacaactccagcatctggaatattagctgagtacattcttaccgtattatcggtacgaggagcataaactccgtaagttccgattgtaattgcacatgggaatacgtgaccaccattgtaatctgtgtgttcaccaattaaattgattcgtccaggtgaaaagaaaaccctttcaggattggtgtcgaaaatttcggaaaattctttttttaagtcgtttgcgttcatgatgtgtctcctccataattttactaaaattttattaacttgaatatatagcttttaccatcacttgtcaatacctctttaatccatttacaacaaaaatggtagcgcttcattaaaaaacactagtgttatagatttagggttgcttacagcttactaaatcctccaaaaacattaattttggttaaattttaactaaaacaacgtatacaaatttagggttatgttctattatttcattgtaagcgttttatattttggttacgaaaggagttttattatgcaagcaaatcttcagtggcttgatgatcctgaagtttttcgagtcaatcaactacctgcccatagcgaccaccattactatcgtgatttagacgaaatccgtacaggtagcagctttattaaaagtctcaacggtccttggcgttttcactttgcgtccaccccgtctgaacgtccgctccatttttattcacctgattttgatagtgctgattttgatacgatccaagtaccagggcatatcgaattagcaggctacagtcaaattcaatatatcaacactctctacccttgggaaggaaaaatttatcgtcgtcccccttacacacttaatcaagaccaattagaagttggattatttagcgatgctgctgataacagtgtcggctcttatttaaaacactttgaccttgatgattcatttaaaaatcagcgagctatcattcaatttcaaggagttgaagaagcattatacgtttggttgaatggccattttattggttatgctgaagatagcttcactccttcagaatttgatttaaccccttatcttcaagaccaagataatcttttagctgtacaggtttataaaagaagtacggcagcctttattgaagatcaagatatgtaccgcttttctggtatttttcgtgatgttaatctcctcgctcttccggccgcccatgttgtggatttagacatcaaacccgaggtaaaagatgattttgagcgcggtaccttggcagttactgctgacgtttctggtactgatgctatcttagaactaaccgttacggatcaaaataaacaggtagtggccagtcagacccaaagcggaacgggtaaggtcctgtttgattccatgccgtttgataatttgaaactatggtcaccaacaaaccccaccttgtatcagttgttgattaaagtctacaacaatcagcatcagctcttggaagtcgttccttatcaatttggttttcggcgagtggaattacgtgaggataaagtcatttacgttaataaccaacgtttgattctcaacggggttaatcgccacgagtggaatgcacatagtgggcgtgtcatcaccatgcaagatatgcagaacgatattcagacaatgcttgataataatatcaacgctgttcgaacttgccattatcctgatcaactaccgtggtacgaactatgcgatcaagccggtctttacgttatggctgaaaataacctagaatctcatggttcatggcaaaaaatgggggctgttgaaccttcctataacgttcctggggataatcctcattggttagcagcagtcgttgatcgggctcgttccaactatgaatggttcaaaaaccacccatccatcattttctggtcattaggcaacgaatcctttgctggtgaagatattgcggctatgcaaactttctataaagaacatgacgcatctcgactggttcattatgaaggtgtcgttcgtactccagaattacgcgatcgtatttctgatgtagaaagccgtatgtacgaaactccagctaacatcgctagctatctagaaaataatcccgataaacctttcttaaactgtgaatatatgcatgatatgggaaactctttagggggcatgcaatcgtataatgatttaattgataaatacccaatgtatcaaggtggcttcatttgggacttcattgatcaagctctgttagttcatgatccaatcacccagcaagacgtcctacgatacggtggtgatttcgatgaacgccattccgactatgagttttctggtgatggattactatttgctgatcgaacccctaaaccagcaatgcaggaggtgaaatactattatggattacacaaataatcaattacacgtcatatatggcgatgccagtttaggattagaaggtcctaactttcactacctttttagttacgaacgaggcgggcttgaatctttagtggttaaccaaaaagagtggctctaccgcacaccaactccgctattttggcgagcaactactgataatgatcatggaaatggttttgatgttaaagctgcacaatggtacgcagccgatcgattcacaacttgccaaaagattgacttaacagtggatgggcaactcgttcaaccgcttcctattgctccccttaataatcgctataccaaccatgaaatggcaaatcaagtggcgttaacctaccatttcgttactccgacggtgccaagcacttcggtaagcattacctatacggttgctagtgatggtaatattaagatcatgacccattttgcaggacgtgaaggtttacctgagctaccagcatttggactacgtttcattatgcccacgaccgctaccggttttgactaccaaggactttctggggaaacttatcccgatcgtctagcaggggcaactcaaggtcaattccacgttgacggattaccagtgactccctatcttgttcctcaagaatgtggcatgcacatgcaaaccagtcaactaacggtaactcgttcgactactcaaaataacgccgatcaaagcaagcaaccttttagccttactttcagccaggcagatcagccgtttgctttcagttgtttaccatatactgctgcagagcttgaacaagccactcatcttgaagaactaccattaccaagacgaaccgtgctttcgatctacggggcggttcgcggtgtcggtggaatcgatagttggggagcagatgttgaagcaaaataccacatccctgctaaccaagatttagatttcagttttaatattcatttctaagataaagccgatgctggaaagatttaaattctccaacatcggcttttaatatgcaaaaaaagaacaatcaatgaataaatcattgattgtccttttaaaatccaactttaattagataatccggtattggataacttcaatacatcttcgctatccttaacgtcttcacccagctctttgagataatcaaattcaggcatatccttgttggtaatgactaccattacagtatcatcaaggcctgcttttttaattgcaggctgccagaattcaattaattcttgtccttgtttaacgtgatcgcctttttcaacatattgaacaaatcccgtaccacgcatttcaacggtaccaattccgatatgaatcaaggttaagacgcctgtgtcagaacgaagtccaatcgcatggcgagttgggaaagttgctacaacttcaccatcaaatggagctaaaacttgaccatcggtaggtttaattgcaaatcctttacccatacttccactcgcaaatgtctcatctgcaacggtgtctaaactgattaattttcctgaaaccggattacggtaaagagttgtaattccgtcttctttttcaatttctgcaggtgtttcatctgtttccaaatgtgttgaccaagttttttccagctcgtcaacgatttcagcatgcattttttcgtccaatttaaccttcttgaagaagatgaaggctccaattaaaatcatagctgctggaacaccaaacatcatcaacttgaaaatagcttgtccgtgggaagttacgtccccagcagttgctccagcggtcatgccagcccaaacggcagttaaaccaactacaccgtttgaaatagctccacctaatttatcaagtaaaggacgaacagatagagttaatgattcgtcacggtgaccaaatttcaattgtccatattcaacagaatcacttaaaaccatcaaaacaactaagaagataagtggttgtggaatgtagaatagtacggcagaagttaagatcattggtaatgattgtccggcaagtgcaaacataatcaaagcaatgatcatgactgaaatagctaagaagaatactttacgacggctaaacttctttgccaatggtgggaaggccaatacggcgaacaccccaatgatggcgtttaatgaaccaagtaacgtaaatttcgaagcatcacctaaaatgtaagtgaagtagtaaagttcaagtgagttagtaattgccataccggccgtataaattccgtaagttaaagataaccacattaattggtcgttacgagccaatactttgaaaacttgtttgaaagttgttttttcagtatttttacgtaattcagaatcattttctttagttcccattgctacagctaaagctgaaatcaaagcaaccgcagcgatgataatcccgaaggccatccaaccacgattatcaccttgtccgctgttcgccttggttgaaaacatcaaaacgattggcataacgactacaccaacgatattttgtccaatattagaaccaacccgagcataggtagctgttttttcacgttctgctgaatcaaatgaaatcgcaggaatcattgaccagaacccaacatctttaaatgaatagaaaatatccattgtaatatataaaatagcaaaaacaattaagtataaaattgggttagatgtatttaaaccacctaaactggtaaataaaagtgctaaaacaactgaaccaatcgttccaccagtaacaatccaaggcttgaaatgaccccagcgtgaattggtattatcaatcgcgttaccaattagtggatcaattgcaagttctacgaaacgtaacgctgcaatgatcatcgtaatgtacgcgatcattttagttccttgagccccactactcttatcaaataaatgggaagtcacgaacataataaaataggtcgataatgttgcataaaacgcatcatgaccaaatgcaccaaatgagtaagctagtcgcgaagtgattttacgacttttgctttgtttaacttctgcatccataatctataccacatctcctttaattatctatgcactaaatgtaatcgttttcagagaggatgtcaatgttttttagtaaaatttgcttaattattttagtaaattagtatttaaacgacctagtccgcttctcagaccaatttatcgttgcccatagccaactattccaatcttttttcgattttaattttggtgttttaggccactcgatgtagttttactacctactttttaaattatttaaccattaaaaaagcgctcggtttttacaccttacgcttaatttagatttagtttaaacgttcatattgataacgaatagtatttgtaactggcttacctggacgtaaaacaatatcaccaaaatcagaatgattgattgcatcaggtaatgtttgtgcctcagtagctaaagcattgtactcatgagctgcttcttggtcagaatcaaatgggttcgccgtgaatacaactagtccgttgcgatctgaataaagctttactcgacgtttaccatcagtatcacctaccattgcaataggagtagtttcactcggattaacttcgtaagcatcatcaaattcaatcccaccattttcagcgtttaactgtttcaaggcgtcctcaataggttgttcttgattaaaatcataggtggttgctttaaccgaaagcttcttgccagtgggaactttttcttcatcgaattcaaggtgagctgtactgctaatttgcaaccattgtttagccaaacttgttcgatcatccgttgtattccaataaacatgattcgttgggttaaagagcgtcgcagcgtccgtatcacccataaatgaaatcgaaacttgattttgattgtctagggtaaatttaatttctacatcaaggtttccagggtaattatcatcactcgccttaatatgtttcgataaaatcacgctaacttgatcatcatcttcactaaatttaccatcgaaatttaaggtattaaaaccgtggtcaccaccgtgcaatgaatgagtttgttcgttcatctcaacttggtattcttgatcatcaatcttaaatttagctccgccgattcgtccagcaactcgcccaattgattgacaaaggcaatagcctacgcgttgataatcagccatgctgtcaagtccccaaattaatgagcgttccaccccatcctcattaactacgaattcttgccatgttcctccatagctcaaaactgaaattctagtttgttggtcattaaccaatgtataacgtatgacatcctgaccatctatttgatcaaatacttcttttttagtttccaatattatgacacctccgtattaattaaaccgctttcatttttagtataccaaatttggatgggattgagtaaatattttagttaaaataaaaagactcatagtggttggataatttaatccgaccactatgagtcattcacttctattctatttcgtactagctcgttctaccaaccttgtacccagttccacacgttgcgtggtggtgcgaccggccaaacgactcattactaaattgactgctgtggcacccatcaactccgtatcaacgttgactgcacttaattcaggataaacaaaagtagctaatgaagtattgttaaaactgaataacttaactctgtctggtactttaatgccattcgtctgaagtgctttcaatgccccagctgccatgggatcattggccacaaaaaacgctttaggtaactgatctccaagcacatcaattgccttttgcatcattttagaaccagattcgctagtataatcaccctcgaatacaaattccggtttaaaggcgttacgctttgtcatcgcggccttaaatcctaacattcgacgatctgtaacagttaattggtgatctgtcgtcatttctaacccatggataatcccaatatcttcaatcccctgttgccagaaataatcgactactttttcggtggctaattgaaaatcagttatcacactgtcaaagccagcttcgaattgatcatcgtccacaaaaactaaattatcagtaacggctgcaatttcttcaacttgcggtttactaaattttcctactgctattactgcatcaacatttggacctaattcttgtaaattattctgaaaaattcgtgtcacttcgaattgattgtcttgtccacgttgttcaattcccattcgaatcgacatataatacaagtcatcttgttcttcagtttctgagtaccattgaacaattgccaagcgttttctagttgttaaattattatgtcgtttacttttggaatagtgtagggcttcggcggtttttaggattttttgtctagtttcatcgccaactgaaagagacgcatctttattcagcacgcgtgatacggtcgctaacgatacgccaactttatccgcaatatcttttaatgtggctgccatgagctgcctcctttgaattacttaattgtgcataaattcatttttctattaatgtacctcgactggcacacaatcgtgatagcactcatgtaaaactttatcattaaatattggaattggcgacaacaaaagtcccttcttttaataaaaagtgaagtatatttttacaaaattttgctaaaaacttatcctcttacgtcagcaagttcatattcattataatttcacgcatattactcagaattttatccgctccagtttggtcaatatttgttttaatagcccatactaacaaacctgcttttttagctgcttcaatcccaatagggctatcctcaatcactacacatttctctttatctaccccactctcgtcaacagcttttaaataaatatctggagctggtttattattggcaacctcttctccactaagaactatgtcaaaatattttttcaaatgacattcaatcagcattcgttcaatttcgattctttctccagccgatgccaaaatcattttgattttattactttgtaaaaaagaaatcaccttatatacatccttatccacatagtctaaataatcaatcacgtgacttttttggtattttaaatatgtctttttaatgttcgtgcgttttttttcatctgctaccaagtgttgccaaacttctttattcgatgcacctatgtaatcttttatatcagtagagtcaggctttactcctatttttttaaaaaattccattctacgttcaaaataaaattcttcggatttaatcaatacaccatccatatcaaatattaccgctttatacataaaatatctgcctcctaataaaaaagatagagcacaatgctctatcatcaaaattttactttttagtagttttctagtttccacatgtaacgacgctgtgttagtggatgctgacgagcttcagccagtttttcagcgtatacccgcattacacctgtaattaacataggattgaagtagtcaataacattgctagaagcaattgatgcaagtccatgatctttagcatcaataaccgttagcttagtatcaaaacgttgtaagaatgccattgcacgtgcatctaaatgacgtgtattaccatcgctcatgaacaaaagatatggcgtgtctttgagtgctaattcaaatgggccatggaagaactcacctgaatgaatagttggtgaactaatccattgcatttccatgaacaagaaggacgctgttgaatatgcaacatcagcacttgcaccactacctagaacataaatcgtattttcatctttgtacttagtagcaaattcttctgcggctggagctaccatattagcttcttgattaattaaattaaataatccctcaaatgctttttgcgcatctgcatagtaatcatatccttcaaattgatttacaatttcgattgctagttgtagtgcaagtgtcattttttcggttttatgtgcgtaatcttcttcaaaaccatgaactaagctatattccgcctcattaataatggctgaattgggtacatgggataatgttacaacatgagcacctagttcacgagcatgttttgtcgcttcaactgattcaggtgtacttccacctagtgaagctgtaataacaattgtattttcatttacatctttaggagtgtcgtagttaaattcgttagcttgcataattgatgataaaagatacttactttcatgtgaaataaaataataaccagggtataagtcagccatcgatgcaccacatcctgtaaaaatcactcgattgatattgccgttctttttcttaatatctccaataattgactttggtgtaatgttcataataaaattcctccagataaatatttttttaatttttaataccaatattttaagcaaaaatacctagcacactaaataacaatccgctcaatatacaaattgttaaaatccaaccagtcttcacttttctatgaagaaggtaatacataaagaaagtcacaagaagtggtatcatttgagggaaaatagtatccaatgttttttgtaaattgaaagtttttcccatatggataggtgtagtaataccaatcatgctagctatcattgaaccaattaccattaaccctacaattgttactaaatacattgcccgatccataattccttgacttgtcagtttctttaagaagctatttccggtcgtatatcctaattttccaccgtaatatgtgactaaagccgctggaataaatgaaattaaaattgctaataatggtcctagaatactaccttgtcgagcaaaattgactcctaatccaaaagcaagtacctttattgttccttgaaaaaatgaatctccaactccagacaatggacccatcagagatgctttaacagcattaatagaatctggattaaacgtcgttgggttctttgcatattcttcttccattgaagagcttaatcccaacacaaatgcactagtctgaggagtacaattgtaaaatgccagatgacgtttatacgcctcttttttctttcgtaactcttcttcattatttacatcgtacaaacgatcaagagtcggggctattccatacaaaaatcctagattcatttgtccttcgtagttccacgatgcttgaattgcatacgatctccagaaaaatgaccaatatttttttcgctgttcttgctttgttaattctaaattttcagccattatcaactcacctcctaaagttcttctaaatcatcatccaactcatcatcacttgatgcttctactacattatttttgggtaaaatttcattcaatacgagtactaacagccctgcaaaaattgccacacctgtaactgataatcctccataagctgtgataaagaatccaatcagtagataaaccacagttttcttagaaaccatcgtttgcattaacaatgcaaatccatatgcaggaagaatcttacttgctaggtttagtccatcagtaagccatgagggaatagactgaacaatatcttttacaacatctgcaccaaaataaattgctataaatactggaacaaagtacattaatgaatataaaattggtccccataaaatatgaaatcttctcgctttagcaaaatcaccattttcaatatcactctcagctctatgaacaaatgtcgacataaacatccttaaaagaattcccaccatttgtcctaaaatagcaactggtagagcaattgttaaagctgtttgtgcatttgtatgtgataaaattgcaaaagcagtggccataactgatcctaaaaccaaatctggtggtgcggctgcgccaacatttacgatacccataaatattaattctaaagatgctccaacaattaatcctttagttaagtctcctagggctattcctacaagtgctcccattactaatggctgctcaaaatttgtacgacctaacattcgagaatccataacaccaaaaacacttattatccctagtaatatcgcttttgttagcattcatctaacctccttattaaaactaaatcaatgcgtctagactttctcttttagaggtaggaacttgttgcataaataatgtaatgccttgttcttttaatctttgactacttcttacttcttcatcattcagaaacaccgcattactgtatcttttagtatctggacggttttttactcctccataattgacttccgttattccatttaaatcaggaataatttcaccagcttgtaaaacgtcaccgaaaattaccatagtattgctttttagtttattaattttttccattctctcttttgcttgagttacgctaaagacgcttaatttaatatctgccggtttagataatttaagagacatttttttaaagtcatctcctgcagcgtcattatcaatcacaatgatacgttcaatcccttgcgattttgtccaagcgaatattacttgtccatgtaataagcggtgatcaattcgaactactttaatcatttttattcctccttaattgtctgaattacctcgttgacattaatcaaaccctttcttccctctataaccaaattattaatagcttcaaaatcaacgcgaccacaataagttgctaaagataaaacaaacggtaaattcatacctgtaacaagaaatacatctggatttttaagtaccaattcagtcattgcattattaactgatccacccatcacatcagttacaattatcaattcctcatcatttctattttgaatttctttatttatatctgaaacaaaatcaatattttcctcatcatacgcagaataagctttaatgtttgcttgatcacctacaatcatatttaatgtatttttcatacctttggccaattctccatgacttgccaaaattattttcaatgtcgttcactcccttacttttccttacacctatataaagcaaaaagcgtgccaaaaaaacaggcacgcttctttaaaactattaaaactgtgtactatcaagcattagcacggataatatcaaaaatatatccatactcagactctggtatttcgacactataaatcttttcaatcacactaaaagcttcttttatccatttaaaagtttgttttgcattagtgtcgccaatcacagataaatcataagttgtaattggttcatttctaatcaatctttcaatcaaacaactaatgtgcacgtataacgacattcttgttacatttccaattatttgctcacttaaatcactatatgatttgatggctcgatcaatattatccatcaccaaatgagcatccaaaatagttatcgaattaattaccctctctaatgaaaaattatgaattaattggtcattaaaacttagtatttgttcatctgtcatacatgcttgtaatgcatcattaaatttatctatttcatttccagaaataacactttctaaagaaatatatggagctttaggtaaccctggatcaattgttcccactacagctaaaatattgtataacttgttaaaaatagcaatctgctcttcgtctttcaaacgttctatttcaaaagcttgaatgtcacaatctacttcctccggcatactatctaataaaagatttttcacattattagctgttccaatccccgtaaaacaacaagttataatcaaattcttttttatttctttaggataaatcacttgggtgcttggaataattttacttctaatatcgtccataattttattgatatctttgcgttgccgaatatcatcagctaccaacaatgcagattgcgtcgaaacattattcacaacccctattggaaaatcaacttcattattaataaactcttgaatcccctcaagtgatcccatatctaccattaaaattaaaccattattaatcgaccgattctttatgtagctatttatcttactgcctatttcttgaacatcaatatctaacggcatatcaattgcatctaacacatgctcacctagcatattattaatcacgctggcaatactactagctgtcgaatatccatgtgacagaataatacatctaatattttgagcattggctgcttttcttacactacgaaggtataaatgtacgaacaattcatctacagtatccatataaaaattcattgctttatttgtaattaatttcatatcgttaataacattttctaattctaaatcctctttccgaaatgaatctataatttgaacaagtatttgttcttcggaatttttaagatgccaattagaacgttcacgattataaaaataatatgacaaaactagcgccgcatttcccataaatttaatatcttgattgctttcaatattgacaacacgatctgaaaaaatcttttttaaaaattcaatcgatacatcatttccatcagaatcttttttaaaaattaagtagtcacataattgattaatctcatcaattgcattattaacaaacgtcatacgattatgtttttgaccatactgcttaataatttttaaaattgctctcttgatctcatccgtatatgcttgtgactgcgaaattaaatcatcaatcgtcatttgaggtagtacacttacaaattggtcactgaaagaaagcaattttgaatttttaatattttgatcaattactgtcttaggaacgtcagaaagcatgatatcaattacgttttctttttcagatctttgtaaactgttagcaactgaaattaaaaccgtatttttaagttgaccaacatttcccaaataacttcctgaacttaatatatttaaaacagaggtattaacctgaatatttctctctattctttgtgcttgggctaaataaaaggactttaccaaattttcacgttcctgtcgcggacggtcgttcaattcgggaatttcaatttgaatcggtattcgacgaataaaggtatctaagaagtgactttggacatcttcagttgttgcaaaaatcaagcgtacttttacagaatgggccttctttgtctctcctaaaggtgtaatctttccattatccaaataattaaataatttttcttgtcctttagcatctaagcgatggatttcatccaaaaatagcatcccattatctgcttcatcaaataatcctttactatcttcactagctccagtaaatgctcccttacgatagccaaataaattgctggcaagtagttctggattatcagcatactcagcacaatttaaatgaacgaaattagaaccttctgcgagaaaacctttatcaacacaatattggtaaaaaactttagctaaaaaggacttaccagtaccagtagaacccgtaattaacactggcaatccagctccaggatatcctgccgctgcctttagcctttcgattggcgtataaagtgacccttgagagccgataactacgtcaaaaggacttatctttttaggattttctaattgtgcagttagatcctttaaacttgcatactcatggtcggttaattttatttcatagcgctcttctagttgttttctaccccaaaataaaaccggacgtgaattaattttaattgcttgtccctctttgcaaagctcatttaaataagcactaatcgtatttcggcgcacactaaaatgttgacataaactttctgcagatactccattattttgccaatctttattggccgtttcatcttgcagtaactccataacacgttctttaatcatcgacactaactccttcaccacttttgaaaacgctaacataaacactgtcagtttaatatagtttttgtgtcggagcaatgcttgaattatatttttaacactctaattacaaaaaataaaaagtacatccctgctcgtagtgaccctcttagctagatttttggactaaccttgggacactataactttggaatgtacttctgtagcttaattattcaaataattttactaaagcttggcttttaacatcaaatagccctttatccgacattttaagttctggtgatactagtaacgataatgttgaaaaagacatgatttcgttcgtatttacatatcctaattctcgcatttgtttacgtagctctcgtacttggtcgcctagaatttttatgggtaattcgcttaccactccaccaactggtaacccgacttctaccgttacttttccttttttagctaccatataaccaccttgcttctcaattaattgattttgtatagcaagcatcgatgatatttccgttcccaaaaccatgatattatgatggtcatgcgcccaagttgcaccaatagcccctaattgcgtaatcgattggtcaactaacccaaaagtaatatctccagttttaccataacgttcttgaatcattaaaagggctaatccagcttcttcccaacaaactttgtgattatccaccctcaattctttacttacctttttggtaaacgtaccttgcttgctaatctgaattacattagcattaacctttccatttttcttttcaacacacaaatcaaaatcttttaaatttaatttttgtgctttaacactatttactaaactatcatcaaaagtaaatttttcatctaatttttcttctaaaccaacttttttcccattcttataaacagaatcaatcttaaaggtatttatatcatctaatacaacaaaatcagcaactctcccaggcattatgcttcctctatcccataatcccattctcctagccggcgtgtatgttgctagataaattgcttcttccgggctcagtccatttttaatcaccaatttaacaatttcgttcaaatgtcctacttgtaaatcatccggcattacgtcatctgtcactagcgctacatgttcaaaaagtttttggctagatatggtccgtaatgtttcctcatttattgattttctttgtaattgaataaacatgccattcataattttttcaacaactgaatctgctgtttgttgtgtatgatctgaagtaaccccgctataaataaatttagctaaatctaaacctgtatacttaggacagtgtccctcaattggcatggttggtcttttggaatgcactcgttcaataattttccggattaaagaattcggttcagacgtaattccttgaaaattcattgcttcgcctaagcaaataactttagggttacttattaattcttcaatgtcctcggctataattgtccctcctgtagtctccatatcggtgttagtagaaggaactgaggagggtatggcataaaacacatcaataatcgaatcttgacccatatacgacttcaatcctttaactcccgcaacgttggcaatttcatgcgcatcagcaatcactgttgtagttccaaatttagctactgcattcccgaaattctgtggagttgtcatcgaactttcaatatgcatatgtgagtcaatcaatcccggaattaagtatttaccattcaaatccaaaacttggtttgcttcgatattagctacatcgttggtaagccaatagaattttccctccataactgtaacactgatattttgaaattcacgtgtaacactgttataaacatgggcattatttattaagagatcgactttaacttcctccaacttaattcctccatctacttgttcataattttattccactctgtaatccaattttttaactgagagttaacatattcaaaatcaattgttttagcacgtttggcaatatccccataggttttattctttgcatcttttgatgttaactttacattattattaacgggagcattatttaatgattttgtggatgcagcacgagtttgtgttttttcgcttaatctataatcaatgtattcataatcattattcaaattcttactattttttacaatcgaaattgtgtcatagtttgcgtacgtaccggatgttggaacagtatattccatgttagacgttgaattttgtatcatacttactgcaaaatcaccaactacagctacatcaatttccccatttttaaacatgtttgctaaatcggaagattgcgtgtacgttttagctacatttggttttaattctttcatagccttcaatcctgctttaccgttatcttttgatatatcagtcttagcatgatcacttgcaacataaagcatcgctggaccaaaggtcgtggtaatatccggaatagcaattttccccttaaattttttatcccataattgatcccaagaagtgatttttccaactttctttgagttataaataattcccattgaattaaccgtatatggaatgctatttgtttctttcgctaacttttgctgattatgggataacgtcttaaaattcttaagtttattaaaattaactttttggaaaagaccttttttatttccagataaagcattattttgtgatagttcaactacatctatactattattaggattatgtgcaatttgtgtataccgagctgcgctatcacctgattgtgttttaacatccaaatcatctagcttctcaaagggtgaaactacatcatttttcatctctttagttgaaataccaaaagttgagatcgttatttttttgctctgtccagctttttgaccacaccctgtaaataaaaaagcagttgccataatcactaccatcaaatttcttttcttcacaatttattcctccaattatccttctaaaggtatcagggcgttctcgtccagatgtaatgtaactttttggttcaattcaatacgttcgccaggccaatcgatctttaattcacctatttttgtattaacaatgtatcgatatgctgttccaagatatataacacttgaaacgattccttcaatcgtgttagatccctttccaaacttaatccgatctggacgaatagtaagacatgttgcgttactatttttttgggaacacgttagttctactccttgtactaaaaatttgccattttcactaatttgatcaactcttaaaaagttactgtacccaataaattgggcaacaaaaatagttttggggtgattataaattatttgtggcgtatcaaactgttcaatacgaccattattcatgacagctacacgatcagaaattgcaaaacactcttcttgatcgtgcgttacaaaaatagatgttatatgtagttcttgctgtaatttcctaatttcttctctcatcgaaatgcgtaatttagcatccaggttactcaatggttcatccattaataacaaccgtggattaacaactaatgctctagctaaagaaacccgttgctgttgcccaccagaaagttcttttggtaacctttgtgccaacttttctaaccctgttattcttagcattttagctactttatttttgatatcttctatagtttcatgccgcctttttaaaccaaacgcaacattttcgaatactgttaaatgaggaaaaagtgcatagctttggaataccattccaaaatttcgtttatgtacaggaacattagaaacatcactattatccactaaaatattcccatcagtttgttccagtaatcctgcgataattcttaaagtagttgttttaccacaaccactggggccaagtatagatactaattccccatcatgaattttaaagtttaacttttttaaaatataatttttcttatcataacttttagataaattttcaacatttaattccgtcaattcttttcacctatttcataatcatttttaatccaagtattttttcaaccaataacattagtcctgctgtaaataacattagtaacactgatattgctgatactgttggatcatagttattttgtaaatagttcaaaatagaagtcggtaacatgcttaaatccacgccatttaaaaacaacgtaatgggaatattattaaatgaattaatgaatgccagcataaacgcagcaataatacttggatatatatttggaattactattttaaaaaagctttctaccttagtactaccacaaacccacgccgcctcttcgagatgctgatccatcaacatcatactagcagtaatcaacctaataacatacggaatacatagtaaaaagtgaccacacaataaagttataaccagtgggattcggattgttatcattaagccttgatacaaagcaaaaccaattacgatttctggaataaatgtgggacttaaaaataacatttgaaaccattgatgatggtgtatacctaaacgagttagcgcataaactgcaggtaccccaactaatagcgctattgtactggccagcaatgcaatcaataaactcatttgaaatcccgttacaaaatctggttgtaaaaatacattgctaaaccatctcaatgtaattccttttattgggaatgtaattgtcgttccttttccaaacgctgtaataataactataattaatggaactattaagaaaaataaagtaacgccactaataattgttagtaatttattttttgaattaagcattttctatacctcgattaaatcgtctcgtaataagacgcattaaagttattgaaataaccgttaaaactattaaaattaccgcaacaatactagcactattccagtcacctaaggtcatcgattcttggtatatcaaagtagccattactaaatgtctatttccacctaagatttgcggagttgtataggcagtcatcgaaccagcaaaaaccagaatacaacctgtcaaaatacctgttattaattgaggtattatcaccttaaagaagctaacgctaggactcgcacctagaatagcagcagcttcttctacctcaatatttaactcatcgatgcttccaactaaacttgtaaccatgatgggaagaaacaaatacaccaatccgacaacaatagcaaaatttgtatataacaaagatagtggcctacttataatatgtagttttataaataattcatttagtaccccatttttgcctaaaattataatccaagtaaaatttcgaacaacagcattagttaatatggggaatagaattacgattgataaaatctttttaactgagcctttttgtcttgaaatccataatgctaatggtaatcctaatattaaaacaataatcgttgtgataactgcaatgcctactgtcctaaaaataacctcttgattataattactagacaaaaattcagtgtaactactatttgtattatccgaactaaaggtcgggatgatcatttgcaacagcgggaagaataaaagcaaaactactgccgccatcccaggaaaaacaagcatccacctaactttattttttatcaaccacttttcctccctttctacgttacaaacatcttatcataaaatcgaactttttaaaccgtttagtttaatatagttcgtaaaaaagtcaaaaaaataaaacgaatacgaagttttgatcttcgtattcgttttatttaaacaagtaaatatataactttatcatttgctactacttaaattaatctttcaaatactcctcattcaatttcaatccgaaacggtcagctaaatctctaaaatctttttccgtaatagtttgcaacatcttaccaccttgtgcttgtattgttgtatatactaaggctgatttttcgatcgtttcaactaaaccaaatgtttcatctaatgaatccccggctgcaaatacaccatggtgtggccatacaacaacatgataatctttcatagtttctgccgtcttttcaccaattgctgttgtccctggacacatatatggaattactcctattccttctggaaatacaactatagattctgggtgcatttgccataatgttcgactcaatacctttgatgatagtggtaacgtgaaagtcattgccactaaattagttggatgacaatgcataattactcgttgctcaggatccttctttagcctttcgatatggctcattaaatgggcaggaaattcacttgttggttctccgccatcatcaaatccccatacaatatcgacgctattaccttctgcattaattttaatcaatcccatatcacgttctggatattccgtcatatttttgaaatatcgacccgtaccggttactagatagtatttaccagctagttcacttgcgttaaatttaatttgaaccgttcgaagagtttcattagtatcttcaaatttttcaacttcatctttggttaaccttaaactaacgttaccaccgtttctttcgtcccatccatgttcgtagaggttcatggttgtttgtttcatttctttaacatattttgaatcaataaacttagtcatattctcagcctcttttaaaatttttattttgcgtctcgtgggaattgaacttcctgttcatatttatgaatatcatctagccaatcagaacccacaggaacgttattgcgtaagcagaattcatcccaaactgctccaaatggatatgactttagctcttctgttacagctaaacgcgttgtgaaatcaaagtttaattctgctttcttcaaatcattgattggagcaagcatcgcttgtaatagtgccttttgtgtagcccgagctccaaccacccaagcagcaactcgattaattgtagcgtcaaagaagtctaatccaatatttgtacgctcaagttcgttatcccgaactaaggaacgcataattcgaactaaagcctcgtcaaatataacaacatgatcactgtcccaacgtactggacgagaaacgtgtaacattaaccctttaccaaatggcataaatgctgagaatttatctgaaacgtcttctgttgggtgccagtgtcctgcatcaatcgtccacaatttaccacgactaatggcgtagttgtcgtagaatagatgtgatcctacagtgtaggattcaattcctgtaccgaataatttaccttcgactgcttcaatagtattcttttcgtcatatttcttttcaaaaatttcatctagagattcaatcaagcgttgacgtggtccttgcttatcaattggattatctttgaatccatccggaatccagaaattattaactgactgttgtcctagttcttcaccaaaataattagcaattgcacgtgattgtttaccaactttaatccaataatcacgaacatctttttctgggcttgcaagagtgaaattatttttgaccattggatgagagaagaatgttggattcatatccaatccagctctttctttcttagcccagtctacccagtatttgaagtcttctggtccaatttcatcaaagtcttttttcttatctgtaaccgcatacaaagtatgcaaggctactttatgctttccaggaatcaaggagaacgctttagataaatcaccagttaattcatccggagtacgtgcaattccaggatagtcacctgatacgccgattcctccagttaattcttgttcagggttaagaaaaccatgaatatcatcaccttgccaacaatgaacagataatttaattttagataatttctccatcatggcttctgtatcaacaccaatttctgcgtagcgttcctttgctactttatatgcactttcaacttcgttagctttaaccatttttcgttcctccattttttattagtctaaatgaaatacttctttaagatctgtagcaactgggctatcgtcttcattagtttccatcaatggtttcatatacttccaccattttttgcaaatatctgtttcagcaatcttgttgtatgcttcaacgtctggaacttccagataagcaaatgtttgcccagtttctttgtttaaataaatcgagtaattatttgcgccgtgttcttttaaggcttctttcatctccggccacaactctgcatggcgcttttcatattcatcgtaagcatctttatgtaagtacataacttgtccaattcgtttcattataaaatcatccccgattctttataaattcctgatattcaactaagatgtctccatacttatctttttctggttgaaaatgttttaatttaaatgagtcagcgattaatttacgtcctgcattaatattttcaacttcatctaaggtaatcatctgtaccaaaacatttcctattgcggttgcttcacttggtcccgcaattacttcaacattagctaatgtacttgttaattgattcattagagctacattacttccgccaccaacaatgtttaatttttcaatatggtatcctaaaattttatctaatttacttaattcatttgcatagaataaagataaattactatagattgcttgaaacaattcaccaggtgtttcaggcactatctgtcctgtttctgaacaatattcctgtagctctttaatcatgctttcaggattagtaaatctttgatcattaatatcaataaattgttggaatggttttacagctgtggccgcctctgccaattctccaaaactgtatttatcacctagctcatgtcggacacattgtgcaatccacaatcccatgatgttctttaagaaacggtatgtcccatatgctccccactcgttagtatagttttctttaaatgcagccaagccattttctggaacgtttaattctgttcccagcaaagaccaagttccagagctgagaaaagcccaacgatctccttgtcctggtgttccagcgactgccgaagccgtatcatgtgttgcaaccgtaatcacttctgtttcaggaatatcaaattcttggtgccatttatgacaaacatttcctaaaattgtgccagattcaaccagtcgaggaaattgattttgatcaacatttactttacctaatagatctttatcaaatagaccgacccgcaaatttagcatctgggtcgttgaagcatttgtaatttccgtaactgcattacctgtcaaaacataaccaatgtagtctggaatcatcatgattttatcagtcttagctaataattctttattttctttatacaactgatataaggtattaaattcttgaaattgaattccagttttttcatagatatactctcgtggaagatcgctggttagttccgtaactgcatttgttgttctcttatcacggtagctaattggatcttctagcttattgccatcgaaaccaactaatacataatcaactgcccaagtatcaatccctagttcaacttcattaatacccatttttttaactttttctaatccaataaaaatttcatggattaaatggtttatatcccaacggtcatgattactttcatttgtaaaaccgttagaaaatctatgaacttcttccagcacaatttttccatccttagattgtgctaacatcaaacgcccgcttgaagctccaatatccacagcaatatatgatttcatgctttacgtcaactcctattttcctaagttcatttcttatctatatcttttccgtaacgttcctcactaatttgttcgagtgattttcctctagtttgcggagtccaaattgttcctataataagtgagataattaatagcactatcataaatgttcctgcagccttaaaacccatatttgttagaatcgtaggaaaaatgattgaccaaattccagctgatccacgtactacgaagaacataactccttgtgatccagctctatatttagttgggaacaattctgtggcccacaatgcgtaccaagcttgcgctccaatcccagctgaaactccccagagtgttacaaataaccataggcttgtccaattcatgcctgcataagttaggattatccaagatgcagctgccattgctgctccaacaaagaagaaaattcgatgattagctttatcgccaaacttagcaaaaccgatataagttgctaacgctgtgaatatccatagtacagcttgaagtaaattggcttgcatattagttaaaccaccagcagtttcataaacatatggcatgaagaatcccatcgcacccgcgacaagattccagaacatgtatactccaatcaaaaacaataacgatttgatgtttaccatgtttgagaataaatcgcgatatggatgtggcacttcgccactagctttttccattttcttttgttcctcaaatacttttgattcttccaacttactttgtaatctccatgctataaatgccactatagttaagaagatgaataataatctatttcccattaatccaattggtgctaggagcgtcccggcaataaagataatggctggccccattgaccatgcaaattgtgatattccaatatttttagcacggtcgcctgagcctgaagtctcagaaatatatgtccaagatgctggaacacctgccccaacggcaatacctgtaaccaagaagccagctaataacataggaaaattgatcgaaaatgcaataatagctgttcccaacatgtaaattaacatgtcatatgtataaattatttttcgaccaaacttatccgacaaatgtccaccaattaatgctccaatcgctgaaccaaatgcattagcacttagagcacctagcaaaccaacttcaaaactagataaacctaattctttggtccaaagagttaatccacttgctccggcaacgattgaacctgagtctagaaaattggtaattgataccgcaaatgtcgacttagcagaaccttgtgctttatcactcatttcttcatcctccttaaaaatgttaataatcatttacaagttgaattgtaaacgcttacacaaaggtgatacaataacattaataatcatattgagtatcatatttacaggagggtacacctatgaatcctagagtactaaatatgttgtcccaaactaatatactcgaagaacaacaaaaaaaattgcacaaatttatagaagatatgcctgcttatgtcatccaaaacggaaaagcaaaaaataaaactcaaacccttaacaacatgctttttaaaaatcgcgatatctacgttagtcggcacaatcgttatgcttcatatcctgcacatgctcatacatttttggaaatgaattatattcttcaaggaacagcaacagaaaccctgaatggaaagaagatagaattgaaagagggagatttacttttattggatgttggggcatctcattcgattgatactttaagtgaaaatgacattttaattaatattctttttaaagaacaagtaattagtatcaatctcttaaatgatctacgtcgtagcaatagtattttatatgattttttaattgatcgctcgctaggagtagatagtacacttaaaaataatttcttgttatttaaaagaaaacctggccatgaaatttctgacgtactagataagatcatcgaggagtattacttaaaacgtgatttttctaattcaattatcaaatcttacttacaagtcctgttagtcgagctagtccgcaactacccgctgaataccgatgatcgtcctaccaaaagccaaattttaataactaaaattctaaaacaaatttcagaaaactataggacgatctgtttagatgaacttgcgcataaatataaatacaataaaaactatttggctaatcttttcaaagaagaaacaggtaaaacttttacacagatggtaactcaacagcgattaatccaagcacataatttaatcacttcttctaatttacccataactgaaataatgcataaagttgggataaataacaaaacttttttttacaagaaatataaagaattttatcaatgtaaccctggagatgatcgttgattaaatttttttggaaaatttacttcataagatgcaaacaaaagagagacctttttaaaaaaatctctttgcaaacgctttctttttgtgaaataatgaacctgttaaaaaatgactagcaaaggagttcttcaaaaatgaaaattaaagcagcagttgttgatcaacaaaatagtgattttaagattaaagatgatattgaattagctgaaatggggccagacgatattcaagttcatatggttgccagtggaatttgtcattctgacgaagctctacgggtgggcgatgctattattgattatccgattgttcttggccatgaaggttccggaatcgttgaaaaagttggaccagaagttacacaatttaaacctggcgaccatgtcattctaagtttctatgcttgtggaaattgtgataattgtctacgtgggatcccaactcaatgccgtaactacgctgctaacaacctttctggtgtacgtccagatggctcaagccacttcactgaaaatggcaatcacgttgcagatatgtttgaccaaagttcattcacttctacgaccgttgttcgtgaacgaaatgccgttaaaattgatgacgatatcgatcttcgtaaagttggaccccttggatgtggctatgtaactggttcaggcaccgttcttaacactcttcaaccacgccccggcgacaccatcgccgtatttggtacaggagccgttggtttggcagctatgatggctggtaagatttctggttgtataaaagtgatcggaattgatattgttgattctcgtttagccttagccaaagaattaggtgctactgatgttatcaatagtaaaaatgttgatgtagtcgaagaagtgaaaaaattaactggcggcctcggagttaattgggctgttgacacaactggtatcactaaagtcatggaagattccatcaaagttctaacccaaggtggtaccaccgcaactatcgctgtaacaccaaatcacattgaccttgatacttggaatgatctttgtgtagatgacaagaagattgtcggtgtcaatatgggcgattcgattccacaaattgacattcctcgcctaattgaattctacaaagctggcatgtttgattttgataagactgaaaaattctttaattttgacgaaattaacgaagcaaatgctgcttctcgttcaggtgaagttattaaaccggttttaattattgatcctgattatgtgcctggtaaataaaaaataaacctttaacttaaaaatcccgaagacaaaaactgtcttctgggatttttattttgtatccaaaaaccttttttgtactaaagaaacgaggaaatccattgaaagcagatattgagtatccttataaatccttaaaatggttttattacctctacaaatcaggatccatcttaaacgtcaacttcgacaattccgctccctgtttcgttagttctgctagaagttttttagtttcatcattataatgctgggcaattaaatggttttgtttagttaaatagtccgtaagttgggctccctcaaggctttcagcttgctggtcaacctcactaatcttcgttcttgcccactgtgataattccttttgataatctaggtccgcttggataaattccgcataatgcgattcaatgaccattgctaatgtttcatataaccagtaggcgctgtctaacgacatttgttcaggtaattctcgatatgaaacgtctgtgtcgtttgcattcgtaaagaacggaacgtgtggacagaaactgggcacgccaaatccaatccattgcactccggcagcaccatttttacgactatcgcgcatttggagaatgtgtgaattagcagttctcgatagcgaaatggcccgataagtcttgcgatcgtgttcactcccgcttccgagaggatcgtatttagtttcgttatagtgagacttcaaaatatattgaatatcctcaactgcaattttccggctagccttccgaataaatggtagttctggagattcaggatcctggtcaatttctggattcaagtacctttgggcaaaccaaacccgtggagtattgtaatgatgatctttttcagtatctgttccaaaaatgtgacggaaattccagcgatctcgatcaggattcaaatgatgttcttccacaaatgtttgaatattttctgaccacatgtagttatcgggatcgttaaaatcaatatcctcaatagcaatttggttagctgccacggcatagcaatcgtctggaattcgtacagcgacccattgatgaccggtcacaatttccatataccaaacttcatccgcatcattaaattggacaccatttccttcagcagaaccatactttttaaccagttcacccaaatagcgtacgccatcgcgcgccgaattaataaaaggcaataccaaagtagtcattgaatcttctgccaatccatttttaacaaatggatcataagccagtacccgttcgtttgcataaacactttctgtggcactttcaccaacgttcttttcgttaaagccgtcctcttcattaggaccatcactttcatccccattcggcgtagaagtataacgataaccgcttgctggtaaaggcaccgtcaacccattgtagggcgatgtataagtttctttacgcccgctaactgctggttgtaccaaaaaacgctttggatgaatggcaattaggcggtcttcatttctagaaatatacgtcgctccatctagggaagctgcttttcctaccatgattgaggtacatgctgacaattcgattcgatcttccataatattctccttcgtaaatttaagaaatccgtttaataatttgttcgttttcttccagatgatttaaatataaccacaaacgactgtataaatactcgttagcttcggtaaatttatgacctaaattttgcccaatctcatagacactccgcttaccatttacttgttgaaatacgaagctcccatattcgtccaaatctaaataagtattttcgggaattttaaaattaagcttgcggaaaaatctttgaatccaatgatcttgtggcttaataattgtaataattccttgttttagttcgtagtccactcgtggattcttttcaaatacaatctcccgtaattcatcatctgttaactgatgctcatccctcgttttcatcacttggtttccgatcttctacctttttaatcatgtaaagtggtacaacgatggcaaccgctaatacaattaagattatgattcccatcgcatttccggcggcaaaacctttaggtgacgcatctttaagcaaaccagtcacgtgtagaataataccaatcaaaccaatgattgagcccccagcgattaaacctgaagaaagactgacaccactttggattcttttagcttttaatgcttctcccttagttgtcttatctacaatcaatttaagcaacgctcccactaaaatgatcgaagtagtcgaaattggtaagtagaaacctaaagccaccgtcataattggtaaatctagcatccataaaacaatcgccattactattccgacaatgaccataatccatggtagatttcccgacataattcccgttgttagcgttgcaatcaaattggcttggggtaatccaaatggtgggttagaaccggtcacctgtaattgtggagctaggatcacggttgttcctacgaccgtaaatacccccacaattccggcaatcatgtagtatttcatcatctcacgattggaaccaccaatcatatagttaactttttgggtctgcatataacccccaccaaccgagattgcggtaacaatgaaaaccccaaatagcaataagatttcactgtagttctgatttgtccatcccattgatacaaaggccaaagtcataattaccaatgaagcaatagtcatccctgacaccggcgcgttcgagcacccgatggttcctgctaaacgggccgaaacaattacaaataataaagctaataatagtgaaagaattccaccaataagagcaactaaaaatgaacctgaaataataaaaccagcgacaaaaattaaaattatcgacaacatcaatgcaatcacacctagggcattcttttcttccgtagcgctattgcgagcgttgattacttttttaattgaagtccagattacggggatcaacttgattgctccaatgattcctccgcaaagcatcattccggccccaatatacttaacgtacgatccagcgacatcatccacacccatttgtgaaatatgcaaagctgcattattccaaacgtgagcacttccaccagccatttgggtaaagtagcttaccaacggaactaccgcaaaatttgaaagaatcgatcccgcaaacatcgttaaagctacatcaattccaactacaaaaccgattcctgctaacatcggattgacttcagtagacattttccaacgataaaatgaatttccggtgtaagtaatcatattgtttagccacccgaaaacttgggttgtaaccatggtaatcaaaccaccaattccgaaaccaattcctaagaatttaagtgaatcaccaccactttctgaggccactaacgcttccgtaatcgccattgattcgggataagctagacgtccatgttcttctacaattagataattttgtactaacgaagcactcccaatggcaaatagcacggctaaaattcccaccatcattccggtccaaaaattaacgtgcccgccaattaaaataatggctggtaaaacgtaaatcattccactggcaatggcttcaccaccgctcgacatgccttgcagtatatttttgcctaaaatccctttttttctggcaaaaatactaaccaatcccgatccaataattgaacctggaattcctgcggcgaccgttaatccagctttcatccctgaataagccgttgatgcaccaaaaataatagctaaaataatccccatgattaagatggctggactaccaccccgttgctttttagtgacatacggtacatgtttaccgcttttttgctccttatttttgccaatttgattccctctttcactcacaaaatattaattacccaatggcacctttatgcgtatcaacaggagtaaagaagtgatcaataatctgtgaaactcgctgtagatccacatttccaccggaaactaaagccacaaccttcttatctttagtccattttggatcaatcttacctgcttctaaagcggccgttggcaatgctcctgctccttcagcaaccaccttggttctctgcatcaaatctttcatcgcttttgaaatttcttcttcactaaccaagacaatctcatccactagtttggaaacaatcccaaatgtaatatcacctggggttgctacatcagttccgtctgctagcgtaaaatcttggtgatgtttaacaattttgcctgcatcaacagacgccttcatgccatgcacattttccgattgaactccgacgatatgaatcgaagggttgatcgactttaaggccgtggcgattcctgaaattaagccaccgcccccgactggtactacaacggtttctacatccactaaatcttctagaatttccaaaccgatagttccttgtccagcacaaattaaagcatcattaaacggatctacaatggtttttccttctttttcagctctttctcgcatccattcgtgagcgtcatcaaaagttgcgccatgaatatctacttccgctccatatcctcgggttgcatcgcgcttcatttggggcgcctcatctggcatcactaccgtagttttaattcccagcaacttaccggtcaaagctactccttgtgcatgatttccagccgaagctgtaattacaccccgttgtttttcttcttcgttcaagtggttaattttgttattcgcccctctaaatttaaaagaaccggttaattgcatattctctaattttaaatagacatccccatggacaacattgttgctcaaaaacatggacttaactaacggtgtccgtcgcgcgtattttttaataacctcgcgggcttcttcaatctgatttagatttaataaattatcagttactgctacaacttggtttctgggttctttctctactaacatcaacgccaccccctttttctatagtttcagttcagtatatggaagattcaaggagtctgccaaaccttgattagtaatttttccttcatacaggttaatcccagatgctaatgctggatcatttttaccagcagctttaatcccctgatcggctatttccaatagataatctaaattaccggcagccaaagccatcgtggatgtccgtggaactgctcctggttgattaggtacagcatagtgaattacgccatctttaataaaaattggatcgtcaatcgtcgttggatggtcaatggtttctaccgttccgccttgatcaattgcaatatcaacgatgactgagcccttcttcatcgttttaaccatcgattctttaaccaacttgggtggccgagaacctggaattaaaatggtcgatataaataaatcagcatctttgatttcttgggctaaatttgcttcatttgacttaacgactcgaacttttttaccttcatataatttttggagctgttgaattctctggtcgttcaattcaataattaccactgagcaacctaatcccagtgctgtatctgctgcaccggtagcggcgttaccgccaccaaaaattacaacattacccgctggaatcatgcctggaattcctgacaataaaataccagcgccttgatgttgcgcttctaaataatatgctcccatgattactgagcggcgccccgcaatttggctcattggtgctaacagttctagctttccatctttgacaatcgtttcaccaccaattgccgttactcctgcttgcatcatagcttccacggtagcttttgcagaggctaaatgctggaagccccaaacaatcttacccttttcaaaatattgatattcttcttcgtcaggctccttaactttaatacacaacttagccttccaagcttccgcatgagaaacaatttttcctcctgcattttcaaattcttcattggaaaatccggcaccaattcctgcatcgcgctccacaagaacttcatttccagcttctaccatcttttgcacattttcaggtgtggctgctacccgtccttcgccttctttttgctccttaattacagcaattttcataaagacacttccttagaatttaattatttacatgtgtagtattgcacaaagttaaccaaaataaaaggtatctcccttaaaaaaacatttgtttctttaattatgtatactcaaaaaattttttaaccaccaaaaatgccacgaaagatttctctttcgtggcattgaataaattatttttaagatttaaatcttactgtaaagcattatttgatgttaacgtatgtcaaaccaaacatgttgctaaggtcttgtaattgttcagcatcaattgcaaatgaaagaactgtatggtgtccaccaccaagtgttagccagccttcagcaccttgcttccaaccttgttttggagtccaaagttgttttgcaactggtagatatggtgtttctttttcagtcttgttaccagtaacatcatatgacataagtttgaattcgtcgccatagtcagccattgtaacgtcaacagcgtcaccttccatacctgtaaatacaaagcgagcagggtcttctttaccaccgatgtctaatgggtgtacttcaacacgtggtgtgtcactagcgattgatgggtcaacttcaagcatatgtgatccaaggattgcttcatgaccttcacgaagatcaagtgtgtaatcttccataaatacagtttgcttgttgtgagccataatcttcaataagcggtccaaagcagctgtcttccagtcaccttcgccagcaaatccataaccttcagccatcaacatttgtgctgctaaacctggtaattgttccaaaccagctaagtcttcaaagttagttgtgaatgctgtgtatccacggtcatccatgaacttcttcaaaccgaaatattcacgaatttgatacttagtattgtgttcgaatttttcggaagagttttgaccttctacaaaattgtagtcattcttcatttcttcgtacttcttgtcaatgtcttcgtcagaaacggcattaacttcttcaactaggtctgcaacaccccagtaatcaactgtccagccaaacttgatttgagcttcgatcttgtcaccatctgtaacagcaacgttacgcatcttgtcggcgaaagttacgaccttaataccgtatgattcgttgtatgcaacagcaacatccatccacttagcaatttgtttttgaataccttcatcgccccagtaacctgagataatcttgttgttcttacgtagacgagcgttgatgaatgcatattcacggtcaccatgagctgattggttcaagttcatgtaatcaaagtcaattgtgtcatatggaatgtggttcaagaattgagttgctaagtgtagcaatggtttttggagtaattctgtaccacgaatccagtttttagctggtgagaaagtgtgcatccatgtaatcacaccggcaactttatcattgtagttaacttctttcattacttctgtaatgttttcagctgttgtagcaactagcttgaatttaactggataaggcaacttctttgattcgtttaacttatcaacgatttcttttgcatctttttctacagaacgtagtgtttcttcgccatataggaattgactacctgtaacaaaccaaaattcataatcttgtacttttttcatgataaaaatctccttattttttagtttttttattttcttgctgcatgttctttagacttagcattttcttgaccgtagtaggcattcttaccatgcttacggtaataatgtttgtctaacaaatattgaggaacttcaatatttcttctagtcatttgaagagcgtggtaatcaatttctgaagcaacttccaaaacctttgcattgtaaaccgctttgtcaggtgtcttaccccaagcaaatggtccatgttggctaaccaaaacagctggaactgcttctggatcaatcttacgttccttgaatgtcttaacaattaccttaccagtattttcttcataaccgccttcaatctcttctttagtgagtgccggagttaccggcacgtcgccgtagaatgtatcagcatgggttgtacttaaagctggtacatcaatttctgcggcggcaaaggaaacagcccatggagaatgggtatgtacaatccccccgatttctgggaattcgttgtataaaaccgtatgcgtaggtgtgtcactagaaggattcatttcaccttccacaacttcacctttcaaatttactactaccatatcttctggtttcaacttgtcatagtcgaccccagatggtttgataacgaatagacctttttcgcggtcaatccctgaaacgttaccccaagtaaaggtaactaaatctaatttaggaagttgcatgtttgcttcgtaaacttcctgttttaacttctctaacattaactttatccctcctaaattacttctccagcttgagcttcaactggtaagcctgctacatattccttagtaaattcgttgtatgcttcaacgccctctggttcggggctcaaggtcatactttcaggattactaaagacgttggtgtctagataatcacttaaactttgaccattactgtcgctagcaaacattgctaggactgccattccccatggcccaccttcgccagcgttagccattacagtaatcggaatattaagcgcatccgataaaacttgttgagcaactactggagtacggaataatccaccttgagcaatcatgacatccgtcttgatatcttcttcattgctaaggatatccataccaatttttagtggtacaaacgcagaataaagttgagtttgcataaagtttggtaggttgaaattactatccgacttacgaacaaataatggtcgtcctgctttgatatttgtaatattttcaccagattgataactataattaatcaaatgtcccaaatcatgatcagctttagttgcttctaagaagagtgcttcatagagcttatctggtgctaggttaattcctaatcttgctgcaaaatcactaaagatttgggcccaagcattgatatctgatgaacagttattaacatgaaccatagcaactggggctccgtcgggagtcattacaacgtcgatatcacgatgaacggatttcaaaggcttttctagaaccaccattgaaaaggctgatgtcccgaccgagatgttaccagttcgtttgcgaacactattagtacccaccattccggttcctgcgtcaccttctgggggagccattacactacccgcttgaagattgccagttacatcaagtaaactagcacccttggcagttaattcaccggctttttcaccagcgctcttcacatctgggaggacttggttgatatcccaatcaaactgcttaacattttctagttcagcaaacgttttcagcattgattttgaataataacctgtcttttcatcgatagggaagactcccgaggcatcaccaacacccaatactttttcaccagataatttccagtgcacataaccagcaagggtcgttacgaaatcaatatccttaacatgttcttcgccatttagaattgcttggtagagatgtgcaatcgtccagcgttgtggaatattgaaactaaatgcttctgtcaattttgcagcagattcttccgtgatgttgttccgccaggtgcggaatggcactaacaaatcattattttttgaaaatgctagataaccatgcatcattgcactaattccgattgatttaatggaagttaatgattgatgatatttgctgtgcacttcagcagccatctgcgaataactagcttggatcccttgccaaactgtatccaatgaatacgtccagatttgatccttaaattggttttcccagacaaaacttcctgaagcaattgtcttgtaatcactggtgattaaaacggccttgattcgggttgaaccaagttcaataccaagtgatacattgccattttcaatttcttttgatatttcaactaaatccattttaataatctccaaactaatttattttccaagtccttgttcttcaatttcttctagtgtgtgaccctttgtttcaggtacacgtgttctgataaatagaacacctaacaaacaaataattccaaagattgcgaacacggcttcttgaggcatgttagctgtcatgattgggaataaaagaccaactaagaatgaaccaatccagttgaatgatgatgcaactccggaagctttaccacgaattgctagtgggaagatttctccaacaatcacccatgttaatggtgcccaagtaaatgaatagaaggctacgtagatacataggaatacaacgatcatcattgggttcatatctttgatgaacatgttaagaacagcgggaaggataaatgaaagtcccataaccgttccacccatggttaacaatgtccgacgtttaaatttatcagcaatccataggaatactagtgaaccaagaaccaaaatgacaccttggataataggccacatcaatgctgaacttgcagcatttccagttgctttttcaacaattaatggaatgtaatagaagatggcatttgcaccttggaattgttggaaagcggctaccccaacaccagcgattactaagtaacggtatttaccacttaataaatctaagaatgttgagctagtattagctgattcttcttcagctgctgtttctctgattgtttttaattctgcatcaacttcattttcaggacggatgtaagataatgttcttcttgctccgtcaatatcattacttttaactaggaaacgtggtgattctggtaatttcaaaactccgaaataaaggataactgctggtacagcggctaaaccaagcattaaacgccaagccatttgttctggtaaatctttaagcaaaaagtcaacaatatatgatagcaacattcctgaaacaatcatggtttggttaatacctgatagacgacctcttaaacgagctggagccatttctgacatataggctggtacaagggccgatgcagcacctactgcaagtcctaagaaaatacgtacagcgattaaataaatttgtccatcgtgtggagaaagcgctgacaaaagtgagccgatcgcaaaaactaacgatgaaatcaaaatcatcttccgacgaccaagtttgtcagacaaatttccggctaaagcgccaccaaaaatggccccaaacattacggcagatgtaatccaaccaattacccccgcattattttgcaagttccaatcagtttgtaagaaaggaagtgctcctgtcattacaccaatatcataaccaaataaaatcccaccaaatgaaccaaagaaataaataaatccacttggaatcttcttttccttactcattgttttcctccttgaaatcacacatccatattttgaaagcgtattcataagttcgatattaatcatagaatatttatacggacaagtcaatgtattttttaaaatttgttaggatgaattttgaataaaaaaataagggtttaagttttaaaaacttaaacccttatatctttttaattgattccctgatgattaattctggatcataaaatttattcttttcataggggcgaccttcggagatatcaaaagaaaatctctctaatattttttaataattcgaaactgaatataattcaccattaattaacctgatacaaattcttagctaaatcttcgattatttaaggtgcactagattcatcaatcaaatattttttgtatacattactttaaccctcaaaattaaatacaacgttgtattttataatacaacgttgtataataatttcggaaaacgttttcaaaaatataactaaggagttattaaacctatgttgatgaataatttaaaagcacaacctgttattatcagtactgatcctggtatcgatgatgcagttgcaatatctttggcactttttagtaacgatatagatgtcaaacttatatgtcctattgcgggtaatgtaagtttagaaaaaacaactcataatacacaaaagcttctaactttttttaacaaagaaatacctattgttccaggaagcccgtcacctctccttcgacaaaaacaaaatgctagtaacgttcatggtgaatctggcatggatggctttgattttcctattcctaaaatcacacctgatgtatcaaggaccgcggtacaagcaatgcatgaaactgtatcaaacagtactgttcctgtaactttaatgggacttggacctttaactgatattgcactttatcttcatctctatccacaggatagtaagaatatccacgaaattgtattaatgggaggagctttaggtagaggtaacttgggagtcttatctgagtttaactttggagttgaccctgaagcagcaaaaatagtatttaacagtaatatttcaatacgtattgtacccatggaaatagggagacaagctaaaataatgcccgccacttcagaaaaaataaaaaatcttggaaaaaccggtaaaatgttttattcacttttttctcattatcgtggaggtagttttgataagggattaaatatgtatgacgtcctcgctttagggttgattttaaaaccagaaatatttgagatgaaatcaacctatgttgctatagaaacccaaggagcatttacagcaggtgcttcattaattgatcttaagggataccttggggaaaattccaatgcagaggtggcaattaacgttgatactaaacaatttgaagactggttcaccaaaatgatatcaaaaacaatataggaggcgatctcatgcacgcagtattaatctctatcattggtattatagctataagcatcttgatttatatgttattaaagaaaaatgatattaaaatgatacttttatcactaggtttaattttgatgtacatcgctatattgttgggtaatgagctaaaggtaacacaacctactggtacaaatttattaaatccatttcaggcaattgttgatcaattttcatcaactttagtaggaccaggatttgttattttaattttaggtggttatagcgcttatatgaaccacataggtgctaatcaagttactgtacatgcacttaccaaaccaatcactaaaattaaatctatttatttactagctcccattgtttttcttattggaaacctattatcacttgtaattccaagtgcttcaaatctagcaattattctccttgcaactctatatcccgtattgcgttctgcaggcatgtcgcgactaacatcagcagctatcatcggaacttcagctacaatagttccaactcccttaggtgcagataacgtagctattgcatcccaatttcacatgtctgtaacagattatgtttttcaaaaacacgctttaatttctattccaaccttgctagctattactatagttcattatttatggcaaaaatatcaagacaaaaagcatcctgaagagttgtcatattcttcagagctttctcaaaataaagaacaggattcaacagcgtcacctaaggtaagttataaaggattcaaagcttttatttatggattactaccgctcttacctattgtaatattgctaattatctttttcaccaatatatttcttcacactaagctgaatattagtgttcaattagttagcttacttagttttgttattgctgtacttgtagaaatttttaataaaaagcatccccaaattgttttaaaagaaactagtaatttttttgaaggtatgggtagcgtaatgagtatcgtagcattactagtttccgcccaagtattcgtacaagggctaacttcgatagggataattgatttaattcaaaaaactatgcaaactatgaatagctcaggtattgttttaccagtagttatggttgtattcacggcaattattgtcttattaagtggaagtggaactgcgttactttatgcaatgattcctctgttattaccattatctaaagctgcaggtattcccctatcgccctatcagtacctatgcaattagcagggaacttattgcgagcaatctctcctgtagcggcagttattttaatagttgctggaaccacaaagttatctccagtaaaaattgttaaacgcacttccgttccaatggtttttggagtaatcatgatgcttgttatgtccctactaatcttttaggagtacatccatgcttaaatctattgaacttcaaccagcttataaagaggacttacctctattactcaatcttttacaagatgcaaaagaacaaatggcttcaagccatattactcaatggaatagctattaccccaatattggagtattaatcaaagatattgaagaccgttctctttattcaactggagcaagtaatattgcagcgattagcatcgatcgaagaggtaaggattggtacttacatcgattaatggtccattcctcagtaaaggggcaaggaatagcaaaaaaaatactctcaaatatcattcaaaatggctattctaacaacgtagacaatatttggataacaactaatcatagtaatttaccgatgattcatattctaactagtttgggattttctttttctcataaaattaaaattcatggaagagaagagtatggagatttcattatttacaactataatcttacacagaaaatgttaagattatagttggattaaacagctaattaatccggataccagtcatttgatgataattggtattcggattaatttttaattcacatttaaatctaaaagatagggagagttaaccgtaaaatgcatcaaccagcaaaatacgttaaagtatacaacaaaatactaaaaatgattgagcaaggccaattaatttccggtgaaaaaattccatctgaagagattcttactaaagaatttgatgttagccgtgttacccttagaacagctttgtctctgttaaaagaagatggttttatcactagtattcacggaaaaggccattatattagtgaaaataattcttatagtaatcaacacctagaaaattttatttcacctattttaactaccttaacagttcctatagaaagccgtgagacatactatcataaaaatacttctagtgcttttactgatcaattatttggtgtacaaaatcgcccttatcttactcttaatgtttggtacaaaaatggcataaataacattgctaataacttagcaatcgtaatgccagaaactatagataaattttctgttaaccttaataatcccaaaagtattgtgcagttcctagaaaataatgtttacaaggtggcttctagttccactttgacattatccgtctcagaaagacatccttctacgtttcgccgtaattttattaatgactctccccttatgttaattacagaagacatattcgatatacacggtgatcgattaattcaaaacaagtattacataccaagtactttatttcgcacagaaatggtgcgtcacccaaatactctctcataaatcactaaaaacgcttaaaaaatactcccaatactagttaactgatgaaaaaaacatttaagtattgggatttttttcgtactaggattataactgacctataaaaccatgttaaacgtattaatccattaaaaatggatagtttaatcgctattaataaggggtcacaaattaagtcttatatattagttttaaaatgatgtaaatttaattattagaatttccgctcttttttaatcaccatgagtttaggtcgtttggtgtttttagacaagttatgcctcttcttttcatccctcattatcatagtatccaaatagttcaagaaaacaagagtaggactaattcataaaaacggcttatccaatatatgaatgatgagttctaaaaactttatttaccaaactaatacaacaccagtgaatttagtctgccattccattctatttttcaacaaattatatctttttaattgattccctaatgattaattctggatcataaactttgttcttttcatagggacgaccttcgatgatatcaaaaatcgtcttggcagcgtctctacccattgtttccttcggatgttcaactgtacttagtttgggagaaatatatttagccaacttataattatcaaacccaaaaattgaaatatcttctggaatctttaatcccatcgagcggactaaatctattactcgaatggcaatttgatcatgataacagataatcgctgttggccgatctggacgcgctaaaatgctttcgattcgagtaaatacattgtgcatgttatcagatgattggtacatcaccatttcacttaacatcactaaatctcgatgttcctggtatgcactaatgtaacccttcattcgatggacaccctgtgtatcatcaattttaaaaattcccagtatcttttcgtgacccatcccaattaacttgttggtaacttggcgttccgcctcataatcgttaacttccaagtacgggaaatctaactcgggatagtgcgcattaatgaataccgtgggtaatcctgtctctttgagcttatcgtataagtctcgattaggatttccaagagcactttgtgttggttcaataatcaagcctgataggccaatttccatcatttttttaattcctttacgttctttctgaggatcgttttgggtgttactaatcaaaatcgaatatccttcagcagaaacgtagcggtcaatccccgtaataatgtttggaaaaatataatctgctatatgcgttgaaattaccccaatcatttttccttcgatgggtttatttatatatttttgccaatcatctacaaacattccaccgccttgtatacggtaaacgtaatgatccgtttcaagatcaccaatcgctcgtctgattgtatatctgctaacgccatactgttccattaaactggcttcggttggcaacctgtcattaatagaataatgtcctgataatattttttctttaatatctcgttttacaacgtcgtatttattttccatatctatacctactctgttaaaatacttcccctatctatagtaacatttcaccaagattttatcgtatattaggtataacttttaaaattacccgataaacttatccggacaatttctaagagtacatgttttagtccccaagcttactacacaaccatattttttgactttttcccagttgcaatcgcttgcaactcgcccctatcctctgctatgctcgtgccaacaatggtaattgtttattcacctaaattcaggatggaggtaattaaatgactgaaagttatcaatttgatgttttgtacttaggcgcggggcatggtgccttcgacggggcggttccactagctaatagtggtaaaaaagtcgccatcgtcgaagcggacaaaatcgggggaacttgtccaaaccgtggatgcaacgcgaaaattacgctggacaacccggttcaacttttacgccaccaagaacgccttgatggtattgtaaatggtgacttaaagctggattggactgccaatgtagaacatgaacacgaagtcatcgacggcttgccggacatgattactggtttactcgactctgttgacatcgaaattattcacggtcgtggaaaatttgttgatgctcacaccatcgaagtggatcaacagcgctacaccgctgacaaaatcgtgattgcaacggggctacgtccccaccatctagatgttatgggctcagaacttacgcatgacagtactgattttatgaaccttaagcatcttcctgaaaatatcgtaattattggcgcgggctatattggcatggaatttgccacgattgccaatgctgccggcgcgaacgtcactgtacttttacgccataatcgggcgttgcgcaagtttaatcaaggttacgtaaaacaagtcattgccgacctcgaaaaacgaggggtgaagttcatttacaacgctcaggtggatcgttttgaggaagacggttctcattttaccgtgtcttataacgatcacgaaaccctcaccaccgactggattttggatgctaccggacgaattcctaacatcgaaaacatcggattagacgaagtaggcgttagttacaatgctaacgggatcgaagttaacgatcatctccaaactaacattgataacatctatgcttctggtgatgtgcttgataaagaacagcctaagctcaccccgactgcgatctttgaatctagttatttaacccaacttttcacaggaaagactactgacgcaatcaactatccggccatcccaaccattgtctttacctcaccacaaatcgcacaggttggtatgagcgtcgaagaagctcagcaaaatcctgattacaccattaaaacaaatcatcttcctgacggatggttccgccaagttgataaggaaacaattggtgataacaccttgatttacgatcaagaccatcatcttgtgggagcagctgaagttagtgaacatgctgccgatgcaattaacgttttattaccagcaattgagttccaatatacagctgaacaactaggccgcatcgtacccctcttccctactttgggagcggacgtctggtcacagatttaaaaaaaacgctgagcctttctgaaagaggttcagtgtttttattttttacaattaaaaaaagtgaaaaatatttttacacttactgccgcagatgattaacccaccaaatgaaaattattatcattttatatcattgcaatattttttaactcgttgtatatttactgcgatgattgaattaaacgttaactattacaaaactaacttttgattaaatcactatttcaaatcacataattaatattgctatatttcacctaaatttgataaaagagaagtgtcagtattatgaaaaataatttttttgaggcggttaaaggtaagttaattatttcatgtcaggctttgcctaatgagccattgcatagttcttttattatggctcgtatggcaagggcagctaaaatggccggggcggctggtattcgcgcgaactctgttgtggatattcaagcaattcaagatgaagccggattaccgatgatcggaatcgcaaaaacagattatcctgattccgatgtttttattacccccactttaaaggaaatgcgggccgtggcagctactggtgtcgaagttgtcgcttgccaagtaactggtcaacgccgaccccatgatgaaaaacttgcggaaatcgttcaacaattccgaacagaatttcctaatacattattgatggctgacactgataccattgaaaatgcacttgaggcagaccgcttgggatttgatatgattgggaccacgatgcgtggttacacgccggccacccaaggtatgaatattgctgatcatggttttgaatatttgaaggaattacgttcccaagttacgcgaccaattatcgctgaaggaaaaattgatactcctgaaaaactaaaacgctgtttagaattaggctgccacgcggttgttgttggtggcgcgattactcgtcccttggaaattgccactcgttttattgaggccgttaaataggacccctgtattaaagactggaatacttgaaaaaagttccagtcttttttattttcagcgtataattaatactaatcaaacctaatctaggaggattttttatgaacatcattgacgttgtggagcaaaaatacccatctttatcgcgtcaagaacgcaaaatcgctctaaaagtcatccagcatcccgccgatgtcaaaaagatgaatatcaatactttatcgaaaaaggccgaagctagtaccgccaccgtaacgcgctttgttaaaaagatgggatatcccgacttcagtcaatttaagttaggtttggctgaagcaacttcaaatattaccgaaaatgttgataatgcacctcttccagatcaggtcacagatttttacaatcaaatgattactggaacttggaaacgtatcaatcaaaaaactttaaatcaagtggcgatgcttattaaaaatgctccccgcgtctttatttttggtttaggtagctcgggttacaatgcgcaagaattatctcaacggctaatgcggatggggattaatgctttcgctccttctgatagtcacaccatgtatatcagtagtagcattatgcaaaaagatgacctcctaatcgttctatctgtttctggcaaatcgaacgaagtcaatgaagccgttgctgttgctaaacaacaccagctaaaggtcgtctccatcactgcttttgatgatagtcccttagccgaaatgagtgattaccaattgtccgttcaatacagcgaatttgttgataatactcaatttatcaactcccaactgggtgtggtttatatcatcgatatcctttcaaccatgctattgcaaaatgaaacttataaagctcgctatcaacaaactgttgcggcgattttaaatcggaaaatgaaataaattaaaaaagatttcagcagggtaaataactcaccttcgctgaaatcttttcatttatatttattttcaatcttctcgccggacctcaaccaccgccgtattttcagctatccgcattaatactgagtcaatattattttcagctgataagaccccttccaactcgactgtaatccgattgtcattgatattactaatcgaaaaagtattttttctaaagcccccctcattgaacattttttgaatggtcttcagtgaagtcgagtcatttttcatgatgatttggcaatgaaaatgcttgcgcttcagcaagtatttcaacatgatgttatcgcgaaagagatactgtgaagccacaatcaaaacggcagccgtgaaaccgataaaatacaaacctgaaccaatcgccattcctaccgccgccgtcgcccagactcccgcagcagtggtcaatccgttcactccttcaccacgcaccaagattgttccagcgccaatgaaactaattccactaataatttgcgccgcaattcgtgagggatccagtccgatgccgcgactttgcaacaaatcataaaacccatattttgaaattagcatggttaacgccgctcccagcgccacgataatatgcgttcgaatcccggcgttttttaatctggccgaacgttcataaccgataaatgccccgcaaattgctgcgattactagccgaccgagtccttctaggtcattcatatccatttacaacaccttcattcactttctatatcatctcacgcccattctaacaccgctttccaagccaaatgaacttttagcctgtcacccacttcaactattcttatagccagcactatcgataccgtgcgtgtaaagtggtatagatttcatttttgctatcttagtagtgatttttagataataaatccatatcattttcaatcggtctaaaaaatattttttatttaaaacaaacgttatagagtccacaaagaagacgcttttattaaatgtcacctgcaaaatcatacttgttaacgatacttctctctggtactattttacgtattaatttttttacaaataatcattctcaggaggacattatattcggatggaactaaaactgaactactacgatgaattccagcagctcagctcaaagcaaatttttactgatcgtaatccacaaaattggaacttaccgctgattaaaaacgctaagatttgtggtgatacaacggtgtatcttcatgatattagcgcgtggaacattcctggagagacgctcattattgatacagaacgcccgccccatactacagatcagtctactagaaaattaatccgagattttttacgctcccaaccttgtcgggatatttttattcgcatgatgaccgatcatctcaatatcacgcaagcacgccccattgtttttggcacttttcgtgtggttcctttgaacggaacaacccgtggttctgccgattgggtgtttgcacatcgactaagagatctctatgcagatcccgaagatagtcgcttttcctttcttaattttgatgacggtaagaaaagccttcagattcacgttccattcactgaatctatgatttgcagtaaattaactaaagcacaacatatttcagaattaacttatgatctaatgcagggatttgctgatatcttcggtatgaccgttcttaaacctaaaaatgaggtgtcttgccagattgatcgtcgaattcaaactaaggagcatcccgaactattaccaattgatgaaaccctgattgacctagctgctcacctatttaccatcgccagcgagattctattagatggcccagttatttctactaaagctgctaaaaaactattaatggaccctgcgtacgatttatggcgtttatagaataaatttcatccaaatctaacccaaaaccagtataataaactataattatacatatattatgagttattaagtaactagtctctgggggatttttgtttatgaagaatacagtactaaaatggatcgaacaacttaaggagcgattccatccgcaacaagaggaccatcagccttttgtcgatgacgagctctatttgggaagtcgaagtcgcaaacgtcgtgctcgcagaagaagtattaaacgtttaagcacctgggtcgctggtttaattgtcgctttcttattaatctttggcatttatcgagggatttcacattttagttcatcccaccgggccgcccgtttaaatgaagaaattggtcagttatatactgataatcgtcacgctgatctaaaagattcggtaactcaaactaagctagataagctcaagtctgatgttgacagtttaaaacattataagaacatcgattccttgcgtgccaaacaagtagctgcacaaaatgcttatgatattcgcgctgattacagtcatcttttcaataaacaaactcgcgttgctttaaacgtgacaactaaaaaggttgaccatcagttgaaaaacttaaagcaaaaaaaggtacccgctcaatttagaactaactatactaaacagttaaaagacgtccgcaagattgtcgttatggcggataaacttagcaaacgctataaagttattatgaaagctcgtaaaaacaatctttccgttgacgtgactacagtagaaaaattgattaaggacatgagtaaaaaccaaaaatcacagaaaacagttgatcaacaaactaagttaattagtttgaagacggtcattaataaggaagataaacaagctgctaaggccgccaaagcggctgcggaagccgctgcacgggcagaagctattgcagctgccgaaagagcggccgctgaatcttcacgggctgaatctgaatcaacttcgaaggccgcttccaaggctgaatctgaatcttctagtgcagctaaagcatcttctgaagccgaagctaaatccgagtcagaagctgaagctgccgctgaagcccaagctaatgctaacgcccagacaagtaccgatgcatctgacagcactaacgatgcaggtaccactaataatactcaggcatattacaactttagtatcagcggcaccgattctcaaactaacacttcaaataccagttactaatttaaaagagctataaccaaaggtcgctcgtcgaattatcgactcccacgtccgcttgattacagctcttttttatttgctatttatcgtgattttcagcccatttttcggcctgactgatcccaattggaatcgcacggtcttcatcatagccttcatctaaaagtgcgttagcaatttcaattgctttattccgcacggtttctgacaagtttttcatcgactctggataatcttttttcgtccatgacatatgactttccccttataagttgatgtgttctccaccagtaacaccatatatttgggcagtagtataacttgctaagttagaagccaataagacatacgttggagctagttcagccggttgacctgcccgacccattaatgatttttgtccaaattctgggatagcttcctccggctgtccgtgatctaactgaattggtgtccaaattgggcctggtgcgacaccatttacccgaattccgtcttcgattaactgctgagctaagttgatggtaaaattagcgattgctgccttcgttgccgcatagtccaacaattggctacttggattaaaggcttggaccgaagtcgtagtaacgatggcgcctcccgctggaatgtgtggtttagccgccttcactagggccaacattgccaccacgttcacttcgaaactgtctctaatttgttgcacggggaggtcatcaatctttttatgggcaatttgttggccggcattcaacaccatcgtgtctaaaccgcccaactcttcaaccacgcgatcaaccacttcttgaggggccttttcgtctcggaaatcgtatggcaataaaactgcctttcggcccgctttttcgatgtattccgcgacttccttcgcatctgaatcttctccagggaaatactggatggcaacgtctgctccttcgcgagcgaaggcaattgcagccgctcgaccgattcctgaatcaccaccggttactaacgctttacgatctagcaatagtccgtgaccttcgtaagtttcttcaccacagtctggtttaggtcgcatctcactctgtagtgctggtgtatcctgttgttgttttggaaattcttctgtatgatacaactttcgtggatcctttaaatctggtttactcattaattcactccctttcttttgtaattcaaattctaatcgaatagaattgctttataaagtaatatgcttcaacgatgtaaccgttttacgaaaggaggattagctctatatgtcaaccaattcgaatcaattcgaaattaccaaattcaaagactttaatgatcttcaaaatctaattgaaaagaatcgatttccgtccaacattgcagctgggatcaagactccggaggttttcccacatacttccacgattaaggatgacagcggtaaaatcacctactttgtaggtctctgtaatttagtgatgaccaatcaaaaatctgactacgaaattgtcctagaccctttaattattgtttcgagtcctaatcaactgaatttttttgttcgggaaaactctaatacggaagctgagctccatcgtctaacgcaggctatccaacctagttcggctgaagcaattattgcccattttctattgcatatttatgataactatcgaactaaattgtctcatatcaagcttcaactagagtatctcgaacagcaatcaacccaaactacccagaatcaagaattaattcagcttaaaaatgttaagaaggataccgttcttttggaacataccttagagacgcaacatcaggctttagaacaccttttcaaactggatgaattttccaataacctccaagatgaaacggtgatttataatataaaaaccgccgaacgtcagatcactaaactagttgaagtttatcgtgatttgattgacgcaatcagcggtcttttttccgatattatgagtaaccatttgaatcatttaatgaaatatcttgattcagcagcgcttattatttccgtaccttcccttatcgcgggcctctggggcatgaacaccggcggcttgcccggtcgacacacgagcgttggcttttggtccatggttgccgttagtggtctattggccttcattacttggattatcttacgattcaaaaaatttaatgactaatttcatccgtttccaagaggtattttaaatcatcgacttgacgcttcaattcggtcccaatcgtggtatcggcaatgttgcgtcgcggtaaatcacgatcaataattcgtttcaaactagtcgattgcgtttgcgattcatacaagtcatcaataccttggaatggcatgtgcgttacaatctggaacccgtacgagttattaattaatgtatatcccgcaatcccagtcgatttttgataagctttggatagtccaccatcgattacgataatttgacctccacctttgatcggcgactctccttcgctgactttgactggagtgtgcccattaataatgtaactattacgttcatctaatccaaattttcgtaaaatataatgcgcagtggaaaggcgatctcttaatttaaaataggggttgtcgccttccttgtgagtcgccgaatcagcaataaaatatcgttcaaaagtggtcatcgccgttctaccaaagaggggcgatttttttccaatccagcaataccacattaaatcggtatcatcatcttcatcactcgttttcttggctgctccagctcgaatgtgacgctcgaaaaaggttaataaatcttttccagcatatttttgaccatgatattcaaattgatcaaaatcaccatcttccgttagaggaatacagccatggtacaacaaattattattgtaaattaaatacatgcttcctttttctaaaatgaagttcacatgcaccttgattttaggtgaatgtctaaaggagtaactcaaactgtcaatgacttcttgttcttccttagtgagttcataaggatgatccgcatcaaccatttggaaacacccattttctagcggatattcctgatctcccaactgaatttttccttgctgaacttcatctaaaaagagccgatcatccatttgaaattcaggttgtcgtttaataacttgtccttctaacttaaattggataatggttagcgcctgatgaacttgggataataaatccaagttgttttggtcaaagtcacccgcctttggataaaaggcggggttagcttgataatgttgcgtggcgaaagtaaataatgctcgcaaattaataccatattcccgttccaaatcataaatataaccgtagcgcgtggcaattctaaataacgtggcaatgcaagcttgtgatcctgcatagcctccgagccagagcacatcgtgatttccccattgaaaatctaacgagtgggcgtgctctaaaagctctaacacttggttggatttgcggcctcgatcaaagacgtcccccacaatgtgaatatgatcaatcaccattttttgaatcgttccagccaagctctgaatcaaatcttgggctcggtctagctcgattattttactaataatctgttcataatacttttgcttgttttttggactaccttctacatataaaagttcttcaataatatacgcatacttgggtggtaaacttttccgtacttttgaacgagaatacttactagcacagaattgagtgagcccaatcatgcgcgtaatcatcccaaaataccactgcgttagttcttctgcatcttgttccagttgccttttttctaaagcatacttcggataagctacagtaaaattcaattcgtttttctctgtctcattcatttctggaaaacaatcgttgatcttttctcggataatccccgcacccgtttttaaaatgtgatttaagccatcgtattcaccgtgaatatcgctgataaaatattctgtaccttttggtaaatttaaaatagcttctaagttgacgatttccgttacaatttcatcttcgctattaaattcctttttcaattcttcaaaatatttttctttatacattggtatatatatccttttttgttttttatttggaattaataccttagatgataacataaataaaaccgcttacaaaccaaacttaaccgaacttgtatttttggtctagggttcaatatttaaaaataaaaatgcttcataacgaattcgctacgaagcatcctttttatttacatcatttttgataatttttcttcaactgaagttgctgtaaccgctaaaacttcatttaaatcttcaatgttctttttaccttgggtttgaagccattgacggccaactgcttcgctctctcccgcaaatggttcgatggcgttacgccaagttgctcggccgcaaaggactccattgaattttgaacctgcttcgtgggcaaatttcaattcttcttggaatagttcagctgaaaccccagcactgaggaagataaatggtagattggttgcatcactttgttccttgtagaacttagctgcttcttccttactataaactacgtcatcatcgttttcagcgaaaccttcaacgtaagcttggttaactggaacttccagcttcagtacatccactccatattcaggttttgaaaattctttcgtcatttcaattaccttgtggggttttaccgcagcatattccttgcccttcacatcgtcgttttcagcgtcgtatgaaaccaattcaaggaagaatggcatgtcttcggccttacattcatcccctaaacgttcgataaatgcgtgcttacgttcgtttacggcatcgccttcatcaacatcataatatagaaggaatttaaccgcatccgcacccaattcttttaattttcgaactgaccattgatccaaaatgtctggaaaacgtccaggttcggttgcatcgtaacctgtcttttcataaacaaccaataaacctgcattttcatcacgaactcgggctgctggtattccatattctgggtctaataggatcccactagcgtatggggttaattctgaagaaatcgccactttaaaatcttcgatttctttttgagtagcttcatgtccactggctgcgccaatcatttttttcaacgatcctcgttggtcgattgcaagggcgctaatcacaccatttttatctgacaatgctttaattccacgtaatttaccattttccatttgaaatactccccttctcatctgtactggttggtaccattcaacaaaacctattttaactggttggtaccactttgtcaaacgctttcattttaaactgaagtagccttaatttttattttttgaatagtgccgctatttcttcaaccgatttagcattttttagttcttgaacaaaactttcatgcattagtaacttagaaaccgatgaaagatatcgtaaatgattaccaccttggtcacgttcaggaattaaaaacgaaattaccgtatcaacgggttggttatcaaaagttttccattcaatcggttgttttaatttcagcactaacattgcagacgtattaattgtattatcttgagcatgtggaatagcgatgcctttttccatcccggtagatcctgctgactcacgtgctaaatatttattgtataccgcatttgcatctgaactatatccgttacttacagataagtttgatagataccgtaatagttcatctctagattcaacatcaacattaactttaatattatctacagtgaggatactatctaaactttcgtcattcactttacgctcatttgatacttctcttttatcttctaatgttttttctccaacgtgagctttatgaccatcagctaatgaaagtaatagccccgaaacaattgctccaattacaataaacaaaacccataaaaatggtttattaaccaaaggtagaacgataaaaccaccatgtggtgctggaacgctaattctagttgtataagttaaaattgctgcgatggaagatccaaccataaaaattggaatattaattaacggatttttagccgcaaaaggtattgctccttccgtaatatgcgttgatcctaataagaagttaacataaccagcacttcgctcattttcagagtatgctttacggttaaaaagtactgaaaagcctgtagctaatggcggagctatgcaggccgcagatactccagccatgaaaaagtaatttccttgtgcaagcaaagctgtaccagttaggtatgcagctttattgattggaccacccatatcagaagcacacataattccaataattaatcccaaaactaatggactagaattttccattccttttaaaaacgccatcatgccggtattaatatctttcatcggtaccgacatataccacataatcgcaccggaaataaaaactccaataaccggaaatagaaaaatttgttttaaaccatctaaagatttaggcaattttttaaataaatgctgtaataaaaccactgtgtatcctgcaagaaatcctccgacaattcctcctaagaatccagtaccattggtataagcaatcattcccgttgcaaaaccaactactaaaccagatctttttccaattgcttcagcaatataggcacataaaacgggtaccatcaaattcattgcaaatccgccaatcgtatttagcagttgagcaaatgaattaaattgagcgctattcgggtcggcagaattgataccccagaaaaaggaaatagctgttaatacccctccagcaacaaccaaaggaagcatatgcgaaacaccgttcattaagtctacatagatactgtgccagaaagttccattagttgtactgatttgatcttctttattatattggccattactgtggtatatcggcacatcatcgtccaatatcttactaactaattcatccggttctttcattcctttagttactgaaacattaattaatctttttccatcaaatctttcaatatcaacgtctttatcagctgctataatgactcctttagcgttgctaatttcttcaggcgtaaattgattttctgtaccgccttgtccatgtgtttctactttaattgaaactcctcgtttcttggcggcctcttctaacgcttcttgggccatataggtgtgggcaattccagttggacagccagtagctgcaataattgtatattttgtcatttactatccctcctaacagtttcaatcttaatttgctcgtttaactcctcaacgtctgaaaaatcagttaatcctgctttaaatgcagttgagcttccagcagcgatactaaatttcaaattttctgctaagctcttttgttggcacattcctgctacgaaagttcctagcatagtgtcaccagaacatgctgtattcactactactcccttaggcgcatctccacgtaaaactgtatctttattaacgaataaggccccttcgcttcccattgataacaggatattttttgctccacaatctattaatttttcacaatatttgattaagtcttgctgactcaatattttcgagccaaaccatttttctaattcttcgacatttggcttaagtaattccggaccaaatgctaacgtatctaaaacttctttataattcgtatcaataattaatttgaatcttttaactttagataactttgcaatctcaactaaaatattaggattgataccttcagaaaagctacccgaaattattaatatatctttacttgtcagcttctcaatcatcctcatcagttcggcaacttgttgcttcgtaacatgggggccactatttacttctttatattccgtgtcctcctctatgactcttgtaaaaacgttaattctagtaggctggtcggtatgaataaatttattggggatccccctctttgttaaagtatcctcaatgaaagaattcgtgaaaccgccgcccacaccaagcgctgtattatcaattcctaacatttttaaaataaatgaaacattcactccttttccattagcctgaatatcatagttattcgtccgattaaccactcttggtttcaactgttgtgtttcaataaataaatcaattgctggatttaatgtgcacgtataaatcatttcaagcacctctttcttatactcctaattctagcctcatccataatgtaaatgttttcaaaaactttgttatttatgttattgttgaaaaagaatttacaatcggagggattggtttggcaaatgataatttgagttcgacagaacaatttgtatggaaattcattcaagacaacctagaattggttccttttttatctattgttgagttgagtgaacgagctaacgtttctacggccactattatccgtgcgctaagaaaaaaaggttttacaggtttcagtgattttaagcatggagtagcaaagaataatagttcaaaggattttaccaatttagagcgtgccgatagtgatattaaaagtgccatcctaaaaaacgaacatgaagttactaacaccatcaaaatgattaatattccagatattgaacagtctgtgcaaagaatcaagcatgccaaaaccatttacatttttgcccgtggtttttctgaattaattgcaaaagaattattagtaaaactgcaactcttgaataaaaattgccaactaagtgatgatccaaatattatccgcactttatcagcagatattagacctggcaatttggttattattatttctctagacggtgaaacccctgaattaatcgaatctgcaaagaaaacatcaaaaaataaaattcccattatattaataactactaatgctgatagtacaatcggtaaatactctacaattgaattatgtggtttcaaatccgaaacaacttattttccagcctttgaagttcactctaggctccccctacaagttatatctcgtgtattattggattcttatgtaattcgtacccaaaaataaaaacctccgaacttcaaaacgaaattcggaggttttctttaaattttcttggttttaacaatgattactcccatgatggttgctaaggtaatggccaccacaaaggctacattttgtagatttccggttgggttcagaccaaaggcccagccataagtcactggtcccagagcggcaatgaaataaccacccgcttgggccatccctgaaagctgagccgtacgataaggattactggtcttaatcgcaaacatggttactacgaacatgaagaaaaggccaatcgcataacctaatagcaaactttcaatcatccaaaatatcgtggacgaagtgttttggaaaaataacattcctgaggcaattaagccggtcactccagcagatcctactaagaacaacttgcccaaccgtccccacttaactaataattggggcaaaagcacggtaatcggcaagccaatcaacgaaaaagccgccatgataattccaattacgcctgatccgacttggtgatacgccatcaaggatggcatccatgcagtgaatgtgtaatttagaatcgattggctcccaaacatgattagaaaagcccatgcttttttattcacccagatttgatcgttggacatagcttcttttttaacttcaacttgcggttcatggatttcttctgatagatgaggcatcaaaaacaaccagattattaatgccaacagaggggtaatcgctaatactattagcatgctccaccatccggccaacaccatgatgggcgccgtgataacgttgaaaagtgccactccaaacatcatcgaaaaggtataaaccgaggtataaagtccaatattgctagggaaatatgctgtaacaaatgatggcatataaacgtttaaataagcaattcccattccaatcaaactggttccgatgatcatcgtcggcattgtaacgatgagtcgtaataatgaacccactaataggatggctaaggtacctaggagtgactttttaaaaccccacttttttaaaatggtcgaggcgacactcgaaaataacataaacattatgagtggcaaagtcgttaagatccccaaactactcttcgagacctccagtttgttagccaaatctcctagcatcagaggtagcgtggtgattggtgttcgtaacatcaatccgattaaaataacgaggacgagcattccgctcgcgcctaaagttccttttttccagttcaaaacattctccttataattcattagtcgatgactattatatcagagtgtaaaaaagccaaagagtcctaaattaatctgcttaggtttcagttttactgaaaattaggttaactgaaaatctttatattatatagtagttatttcactaaaagcgatagcgaggtagttgtcgaataaactcttggtaatgtaattcttccccagttgattcaatttgaacctgttccaaattattttgtcgcaactgatcctcatcaatccagatttggtgggtaaaagtcgcattcccaattaaatcaatcgtatatgcaccatgaatttgattcacccgagtcttgaccatcccacctggattaaagatatcatttacttcacccaatctagtttgaccatcatttaacaagctccaaactaaacttgtcgctgacatccctgtcccacaggcattagtaaaaccaaccccccgttcataagtttggacgaacaattgattctgaccaatgactcgtccaaagctcacgttaactccctttgggaaccaaggattggaagcatttaacctatgacccaattccgctaactttttagttgaaagccggttattattatcaattgctattaaatgtggattaggtaccgccacggccgaaaaaagaagctgatcatcaaaatctcgaactggcgcattaaacaatttatcctgattttcaatttgcattggtaggtttttagcattaaaactaaccggtgaaatttccacctgatatgtgggtaacccatttccaatcgttgctacccgtcctacatgcaaatcggcttgatctgtttggaccaaaaaatcattttcttcatatttttcggctaaataacgagccaccgttcgcagcccatttccacacatgctagcgaagctaccgtcgttattaataacctgcattcgtccccgaacgccagcatggtcacttgaactaactacaagaagtccgtcagccccacctaacaaccctgtttgattattagtaacttgaattgctaattgaattaactggtctggattcattggtatttcgagttgttcttgatcaagtaatataaatgaattttctgaaccgtgtactcgtaataatttaatcatcagtctgccctacctttgtttttaaaaaattctctgtaaatttcacgaacagcttgatttacttggttttgatgaactccgagcatcgttgagattctagaagccccttggttaatcatctgaattccaatttgttttcgtgctagagcattcacaattcgatctacaacgccgaccttgtcacgcattccctctccaaccaccattaagattgcataatcatcaatccattctaactggtcagtgtgcaattcttcccgaatatcggataacaaactgggtaaaatttcgtccgttatttgattctggttgaaaataattgttaaatcatcaattccagaaggcatatgttcgtaactaatatcgtaacgatataaaatttttaataatttcaaggtaaaaccgacttcacgattcaacagatatttgtgtatatacaaagccgcaaaccgacttgagctcgccactcctgtgatttctaaatcagaagcataattttgttcgggttcaattacggttcctggtaaattgggatgatccgtatttttaatcacaattggaacttgagcttcaattgctgggatgatggcttcatcgtgaaaaacggaaaatccagcatatgcaagttcccgcatctcacggtaagtcatctctcgaattggatgtggctgggtaatgatcttagggtcagccgaataaatggagtccacatccgtaaaattttcataaagttgagcttggaaaccacgtgcgagaatggcccccgtgatgtctgaccctccccgcgagaaagtgcatacctcaccattttggttatatgcataaaaaccaggaactacaagatactccgcctcatccagcaaatttgaacaaactgcctcaatttgagcatatgaatgctggtctaagatcgcgttattatagtcaccatgcgcctttatgcccaattgtttcggatcaacaaaccgcgcagtaacattgaatttttttaaaactaatgccattaaaattgcgtttaaccgctcccctgccgccttaaaatgagcaagacggcatgctttatttgcgtggtgcaaatttgctaaatcaattagatgtacattgatttgttcaaaatccgaatcagaaacgtggtatgcatctgcaatttcttgatatcggtctagcactgcttgacgtgctactttgacgttctccccagatgcgttggcatatttgattaatagatccgtcaccttaacatcatctttgaaacgcttccccggtgctgaaacgaccacaattcgacgttcgggatctgctcttaagatttcaattactttttgatattgcgctgcgttagctagagagctaccaccaaacttaacaacttttaccatactagtctccttttgcgaggttctagctttccaactaaccaaaataaaaacgcccattcgtaaaaaaacgaaaatgggcgctagtaattaactaacatcgctaaatcattagtctgatttgaaaagcaccccgctatcagtcatgatagcgacagtccttgagatgttatctcaagacccaacaaacattgagaaaggtcaatgttcatttcggcggatcatcctttcgctggggcatatcgaatccttcattctatcctcagatacttttaatctccgcaacctcttttttaatttaagcctattatactcattctgtactagaatgcaaaaaaataaatttttcataaatcacttctacttagagcaacaatttatgacatataccctcttactttatgcttgacgaaattcatttagtattataaatttgtgaaaattaaattagaaaagggggtaaacgaatgtctttatacaccgtaaataacgttaatcaggttaccataggcggcctaagtgctactcaacttgcccgtcaatatgggaccccactccaagtttttgacgtcaccatgattcgtaatcaaattcaagcctttcaaaaagaatttgaagaccgtggtatgcgcggcatcgtcagctatgcttccaaggcttttagttgcaaagccatttatcaagttgttaagcaagaacatgcccattccgatgtcgtttctggaggtgagattgctacagctttggccgctggttttccctctactagtcttagcttccatggcaataataaatcactcgccgagttgaattttgccgtccaaaaaggagtgggaactatcattttagataattttcatgaattagaattgctcgatcaagttttgaacgaaaataatactcaaatcgatgtattgctccgtgttacaccaggtgtttctgctcatactcacagctatattcaaaccggtcaaactgacagtaaatttggatttgatattgattcaggacaagcattaaaagccatgcgcttgtcccaaaacaaccctcgaatccatctacgaggaattcatgcccacattggttcacaaatttttgaagtaacaggttttaaattagaggttaaaaagttagtcaatttattaacaaattggtctcaaaaataccaatttacagccgatattttaaatatcggtggtggatttggaattaagtatacccatgcggatgatcctcttgcccccgagcttcttctcggtgaaattttagatgaacttcaagtccagtactctaagcttggacaacccattcccaccatttggatagagccaggtcgttccattgttggtccagccggtttttcactttacacaatcggttcacgaaaagatgtccctggtttatccccttacgttgctgttgacggcggaatgggtgataatattcggcccgcactttaccaggctgactatgaggcggtccttgcagaaaatccaaatcagcctccgattgaaaccgttcgtttagctggtaaattctgtgaatctggtgacatcttaatcaaccaccttccattacctactactaagaccggtgatgtactcgttatgttggcaacaggtgcttacgggtattcaatggctagtaactataaccgtaatcctcgtccagcagttgtctttgctgaaaatagccaagctcaattagttattcaaagagaaacatacgcagatatgatacaaaatgatttagattattgaaaattgaaaggggaattactatgagtaatcttgacacccaatccattattaacaccatttcaaactccaaaaagcagacccccgttcgagtgtttattgccggagaaaaactatatcaattacaaataccgaatgaaattgaagcttttatttcaccaacttctggaactctttttggtgaatggaaatacgttaaagcactattagaatcatcttctcaaatcacacactatcgagtcgaaaacgatagtcgaaattctgcagttcctcttctggacaaaaaggaagtcaatgcccgaattgagccaggtgctatcatccgtgatcaagttttaattggcaataatgcagttatcatgatgggcgctattattaatatcggcgccgagattggagccgaaacaatgatcgatatgggcgtcgtccttggtgggcgggctctagttggtcgacattgtcatattggtgcaggtgctgtcttagctggcgtaattgaaccagcttccgctcaacccgttcaaattgatgatcatgttttgattggagccaatgccgttgtggttgaaggcgttcatgttggaaccggtgctgttgttgctgctggagcagtagttaccaaagacgttcctgcacatacagtagttgctggggtaccagctcaaattattaaacgggttgataatacaacttcccagaaaacagcgcttgaagacggactacgtaacctataaggaagtgtttaaaatgaccattgaaccattaaatttagttcgaataaggcgacggtttcacgaatcaccggaattagccctaaaagaattccagacccacgccctacttttaagcgtcatccgctcgctaccgcaaaacttgcttgaaattaaaaccattcccgaactaccaaccgctttactagttcgagttgctggttcgcatcctcatcgaacaattggatatcgagcagatatcgatgcacttcctgtcaacgaaaagactgaccttgacttcgcttccaaaactccaggtattatgcacgcctgtggtcatgatattcacatgacggttgccttgggcatcttagaatattttgctaaccatcaaccgcaagataatctaatcttctttttccagccagcagaagagagccatagtggatcggttcgagcttttaatgcaaatatttttaccaatcagtttagaccagacgaattttacgggctccatagcacgccgacgttgccagccggtgtaattggttgccgcatgggaaccctgtttgctggaactacagaagttaatcttaaattaaccggcaaaggaggacatgcagcctatccacaagacgcaaatgatatggttgttgctcaagcttatttaattactcagcttcaaaccattgttgctcgtaatgtcaaccccatcgaaggcggggttttaacccttggaaaagtgtctgctgggaatgttcgaaatgttattgctgatcaagccgtcattgagggcactattcgcggattaactcagaaaatgattcttctaattcaacaacgcgttcaacaaatttgtgaaggaactgcccaagcctttaattgccaagtcgaggtcaaaatgaatcaaggtgggtatttaccagtggaaaatgatccaaccttaactcatgaattaattcaattcatgcaaagcgattcggccattaaatttaaaaaaactccgccagcaatgaccggcgaagatttcggattcttgctgagcaagtttccaggcaccatgttttggttgggcgtcggtgctaccagttcacttcactctgccacctttaatcccgatgaacgtgccattcaattgggaatcgatgcagtggttaaatttcttcaaaatcgaatgtccaagggggcttaaatatgcttgaaaatgttgatttgatttccgctattattacaccatttgacgatcagttaaaaattaactttactgcgttagaacgtttaactaatcatctcattgaaaccggcaatactggttttattatcgggggaactaccggtgaaacacctaccttaactcacgctgaaaaattaggtctgtatactcgctttgctgaaatagttgctggacgagtacccatcattgctggaaccggatcaaataatacccaagctaccattgacttcactaaagaagttcgccaaattgacgggatcattgccgctctagtcgttaccccctactacaataagcctaatcaacgcgggatggtagcgcactttaaagccgtcgcgcgccaagctgactttccgattatgatgtataacattcccggacgaaccggtgttcaaatggaaaatgcaaccattgttgagctttctcaagaaccaaatatcattggaattaaacagtgtacaaatttaaatgacattggttttttagttgaaaatacccccaatgattttgctgtatataccggaaatgatccagaaactctgggtgcagtcgctttaggcgcaaatggggttgcttcggttgcaagccacatatatggctatcagatacgagcacttttagatgctgtgaaacacggggatctattaaaagccggaaaattacagcgagaattaacacccaaaatggaagccctcttcttatatccgtcaccagcaccagttaaagccgttctaaacgctcaaaattggtccgttggtagtccacgacttcctatcttgccattaaatcaaaaagaaaagctcaatttagcccatcagctgggggttaatcatcttgccgacgtgcagagttgcattactaggaaaggagccattatatgataaatcaggttaaaactgttgtgattgctggttgtacaggatctatgggccaacaaaccgttcagttaatccaaaacttaccgggtttcgagttagttggtggttacgcaccacatgccatcccccaaacatctgattatttggtcactaatcagctagctgaacttccgcaagctgacatttggattgatttcaccgtcccctccattgtttttcaaaatattaagtatgcaattacccatggctatcatccggtcgttggaactagtggtctttcaacgtccgaaatgcatgagctccaaactttggcagctaccaaagagttgggaggattaattgctcctaattttggattatcagctgtccttttaattcaatttgctaagcaggctgctaaatatttcccagaagccgaagtggttgaaatgcatcatcaagataaacaagatgctccatctggaaccgctattgccaccaccaaagccatcagcgcatctcgtactcatgctaacgactatgatgaaattgaaactatccctggtgctcgaggaggtaaagttgatggtgttccaatccattcaattcgtttaccgggctacgttgcccacgaacaagttctcttcggtggaccgggtgaggctttaaccattcgtcaagattcatttgaccgccaatctttcatgtctggagttcgactggcttgtcaaaaagtgaccgatttaaataccttagtggttggtctagaaaatatcttagattagggggctttataaatgcctgaactcgattccgttctacaaaaccaaactcggccggcactctcagcaattagtcgctctgccatccgccaatttgatcaacaagtgtctgatatcccgggaattttaaagttaacgttgggtgagcccgacttaaacacgccagaacacgttaaacaagttttaattaacgcaatcactaataatgcctcccactacgctccgtcggccggcttactgcgtttgcgccaagctgttagtaaatatctactgaactcaactaatattcggtacaacccagcgagtgaaatcttgatcacaatcggcgctaccgaagcaatttttgctaccatgcaaaccattttaagtgttggcgacgaagtgattattccaactccaacctttcctttatacatggcaattgcaaaagcaattgatgccacggtgattgaaatcgatacctcagatactgattttgtactcacagccgatgctttgaaacaagctttacaagcgcacccgaacgccaaaatgctagtcctaaattacccaactaatccgaccggcgcaacttactctaaaagcaagctaacagaactcgcccaggcgattcaaaattcgaagctattcgtcctagcagacgaaatttacggtgaactcagttacgataataagcactattccatagccgaactactaccttctcgaactattcttattaatggaatttctaaatcgtacgctatgactggctatcggattggtttcttagctgctccggcgacgctcaccagtaatattttaaaattacatggattcatggttaccaccgctcccactagtattatggagggggcgatcgaggctctattacatggtcaagacgatgtagccaagatgtgcgaacagtatcgattacgccgtgactaccttgtaaaggaacttaatcaattaaattttcaagttcgctcgcccgctgggactttttatctttttgctaaaattcccatcaatttgatccaaaattcgaaccagttggccttgcaaatcgcccatcaagctaaattagccgtgattcctggcaaagttttcggagctggtggtgaaggttatttacgtttctcgtatgcagcatccatgtccaacttacacgaagccgttcgacggcttacaaaatttgttcaggaggaaaaataatatgtcagcaatcaccgttgccatcctaggagccactggcgccgttggaaccagaatgattgagcaacttgaacagtctaatattgaagttcgtgatttaagactactcgcgtcgccccgttccgtcggcaaagttcaaacttttcgcggtcaagaatatgaagtatccgtcgcgactcctgattcatttatcggggtggacttagttttatcctcagctggtggctcagtttctaaaaaattaattccccacgctgtaaaaaacggcgcggtctgtatcgacaacactagtgcctttcgtatggatccagaagtccctctggttattcccgaggtcaattctgatgatcttgattggcatcacgggataattgctaatcctaactgtagtaccatccaaatgttggtagcactcgccccgcttgatcgaaaatacggtctaaatcgaattattgtttcaacctatcaggctgcttctggagctggtcaatcggcttggaatgaactattagaggaagctcgccaacatcttgatgggcaggctgaaatagctaaaattttgccagttagtggcgcatctcatcattatcctttagcatttaatttacttcctcaaatcgatgtttttgaagatgacggttatacccatgaagagtggaaaatgattcatgaatctaaaaagattttacgccacgacttgaataattcagatttaaaagtaacggcgacctgtgttcgggttcctgtccccgtcgggcatggcgaatccgtatactttgaattagaacaaaatccatcggtgccagaaattcagaccgttttggaccaagctgatggcatcgttttgcaagatgatccccgcactcagctttatcctcaacccatcaccgctgaaggacaccaatccactttcgtcggacgaatccgagctgacgctgaaaatccaggaggttataatctctgggttgtttctgataatttacttaaaggagcggcttggaatgcagtccaaatcgccgaaactttagttcaaagagaattactgtaaatacccttacgtaacaaaaaagtagcatccgacttaatttacaagacgttgctactttttgtcgtgccactgatcaaaccaactttgcttaaaagtgaaagtccttatttaacccacacaaaatttcctcgtccttctacggtccatcccaattaaaaataattgactttttgcattaaagcaccacaatgttaaatgtattaatttttaagagatgaattggggggacggatatgcaaaataatgtatccaaaggattaacggttaacaaaaccttaatcctaattgcgctggggatgttcacgtttatgtcaacattagatgggtcaatcgttaacattgcgatgcccattatgtctaaggagttatctgttacagcaagtcagattgaatgggtcgtatccatctacctgattataattagttctttactcatgttttttggtcgcctaggagatgtggtcggtaagacccgcatttttaaaattggcacggcaatttttattattggttcattaatcgctggaatcaatcttgggttaccatttttgctatttgctcgcggtgttcaggcggttggagcagcgatgactatgtcaaatagctttggaatcaccactagttcttttccaatcaatcagcgtgggcgggcgatgggcttcatcggaactttcgttgctctaggatcagttgctggacccgccgttggaggtttaattctcaactacttaccttggaattatattttctggattaatgttccgattggaataattgctattttattgggacttaaaagtttgccaaaagatgttcctgtttaggccaacgcgcccctcgactggttaggcacactagaatttgttgtttttattgtaactttcttctttgctattttacgagggcaagcaattgggtatacccatccaatcatccttggagcactgttgattgccgtggtttcaattatcctatttattcgtaccgagaaacaacttaagcatcctttactcgatttttcaatttttaagtattcggatttcaccttcggtttgattgcagcattactcgttttcatcaatggtttcttttataacgttttgatgccttactatctagttaatgctcgtggtttatcctctggactttcaggagtcctactttcaatcattccacttactatggtaatttttggaccgattggtggcgtcttagctgacaaatttaattcaactaaaattaccattatcggtgttacgctagtattgttagcccaatttttgattatgggctttcagttggatactccgttctggtactttatttttacttcaattgttaccggaattgggattggtatgtttcaatcgccgaataacgcatctgtaatgtccgccgttccaagtaatcgactaggaatcgctggcagtgttaatgcgttagctcgaaacctaggtatgattttaggcgttagtatctctacatcatcgcttttcttagtaatgggtgccaaactcggtcgtagtattactacttatccaaccggcaacgatcaactgtttatcttcggaatgcatgttgctttcatgatttccgcagctttacttgtcattgccgatttgattgtgattcaacgctggttcgtttccaaaaagaaacataaaaattaattactctatgtaaaatattttatatgctatatcaaaaaagacgtctcacagtggacgtctttttttgtattagatgttactcttttccgaagttctttctgacatcatttccggcgacgataaatgaaccacccaatcagggccaataggctcgctccgaccattaaaaagtttttaatgatggcctgtttttcttcggctaagaaaactgggcgatccttttggatatatcccgttttaattgactgcgtgttacttaacttctccgtgctgttttgccacccctgtcccgttccaacgcccttactttctggaacatatgtattaatcctttgggaagtcaggttggtcgccgttaaatccccttgactgtgataatgccgatgttgatctacggaggaaattcgcgtttggtagtcgattacgtaggtctgcttaatctttcctaatccaaccgtaaaacccttcgtcccattcgtcatgattttcactttaggacaggttgccgttacctcaaaatctttaccttggtcatcaaaggctactcccatgacttcgatggaacccgttaaaagtttttgatggtctccgattagttcggtacaatcgacctgattgagattttgcttagcataattcacacgcactcgccaatgtatcaacgtggggtccttcacatcgtaccaagaccactggtataaagtctcattcggattcggaccgccattgggttttatcttaatttgagctacacgcccagctccccaatttaaaagttgcacttggttttgatcgaccttagaataattccattgcgttcggacactaagagcacctttcactccacctacataatgctccacatattctgtcaatttgactttaactttattagttggtttcaagacttgcactttaccaataatgttacctcgcccatcagtcacatcaaacttaacattactaactaacttcaaactgtctggcactttgagcgtcatcgtatctccagctgtcacccttttagaaactggaatattaaaattccaatgaatcttcatgttatcgtaaagtccaaaagtagtttgcgcttgatctttgctatttctcaactcaacattagtaataaactgttcgccccaatcggttgctgctcgaacactgagtggtttacgattgatgccccaaaaccatagcacagccatcaccaatatcagaagcccttttttattcatgaaaacctctcccaatctcgcttccattctatttatgatttataaatgttaaaaggaatcttttattgccaatttggatcttggtgcttttcagaccaaatgcatctaataatcgtccccacagcaagaattgcgaaaaaaatcgagagcgttgctaataggtgatacatgaacccccaacttaagcttacaaaagctacaccacttctttgaatatttgaatacataactttttcgtcccctattgaattaaatcattaatctagatgattccacgtacccgccgacccgcttaacagctgaaccagcgccccaaggtacgcaatttgtaaaaataaactataaattaattctggaaaaatcattaatgcaaatatctttgcctgccggtcttggttccaaatcgtaatcacccgctcgactgcaaaaatcactccaattaaaaaccaaaagaaactaaaaataatcaagtcttgcaccattaagtaaccggtgaaaacaatcagtcccataaatgctaggactgaaataagtaacattaactgttgaaaaacatatggaaataaaacgcgatcccattttcggcgcaccatttgttggagcgctcctaaataccagcgtcgccgttgtaaaaatagtagtcgccagttgggcataatttccgtcgtgcagtaacaagagattggggaaattattctggcccccgcctcttttaaatcaatcgtcaacgcaaagtcctcggtaatcgagtcttcgtcgtaaaaactacctttgcgagctttaactttctgaaacatctcggcacttaccatcgaagcggtcccggttaaaacaaaaacttttttgctccgcttaatctgattggtgtagcggtaccactccaattgctgacaaaatccaatcatcgaacttcgatccgcatccccgaaaaacaccgaaccgaccgcatcataaccaccagcatcaatcgctatctgggcccgttcaatccaatcatccgcaatcaccgtgtcagcatcacaaatgaaaatatattggtcgggtaattgccaatcaacgtaattttctaaggcttgatttaatgctcctgctttacgatgctgattatcaaccgtttcaaaagccaccgctcctgcctgaattgctttttgataagtatcatctgtacagtgatcacacgccacaatcacttttcgaacttgttgctttaacgctttaatcgttgcttcaatatttgcaccttcattatgggcaggtacgattgccgtgacatccatgtttaacttaccttctccttaattaatacgtgtttccacctaaatatggagtttgattgaccaatgaataaatactattggtcagcttcatcgtcgttgttttacctctgcgatttcccaacaaaacgacggcattgccggcctttttgttgaaaatgattgaaggttcatatccctgcaagatgccgtgcccgcggtaataaagcttattgtggtagactccaccggcataaacactatgtgggacagttttaaacaactccttgacggtcttcattgttaaaatttcgccattgaccaaggccgaaaagtaacggtaaaggtcgccggcggtcataaaaaaactcccggtaccaatctcattacgatagacgtagcgaggattggcgaacggttgcccatttttgtggtagcttacggctacttggggattcgaaaaatccggcatcaccatcacatttacctgattttttagattgactaacgtattaaaactagcactgtaactttgatgcgttagttgcgtaataattcccgccaatagatgaaaattaatcgcatcataatcccatcccttacgcggatcgaccaccacatgcttagcgtaatagttggccaatgctttttcactcagtgttttttctggatcactcgctgcttctaaccccgaggtcatggtcaacatattgcgaatcgtgatatttttagcgttaggaatggacggataaaattcagccagttttgtagcataatccaatttcccctcttgaattaacttcgctaccatcacggaagtcatacttttttcaatcgaggcgatgttatacaaagtatccacaccattttttcgtgaagcattttgttgcccatagcctttatgcaacaaaactttatgattccgaatcaccaaggcggtgccactaaaatcattgctttttaaggcgtaattgatatttttaactaccgtctctctggaacggacgttgtacctcgttgcccaacgatcattgaagtacgtatcatgtaccatttttaaaacaaatattacctgcaaggttactatcacccaaaaccaaatctttttctttgcgcccatttctgccttccatcaataactcattcatctaccatcgtgataaaaagaagctgtgattcatcgggctgcgcacgaacattcctcaaaaatcgtacgtttgacctttcttcacagcttcccgtcgttccttatcctacaaaaaggatattagaatgatcccccgtgtgctaatcaaggactagcacgtttttataatataatccgtgtctcttatcgtaaaggggttctatgtttcacgtttttcatctaattttaaaatcgtgagaatgcaccttaaaattcaaaaagactttttaacagtaagtcccgagcggacgccgttaaaaagtctttggttagctattaattatttttttatcattttgtttaatttttacgattaaatcacctagttgttcccaatcctcagctaaaggtggtgactcccagatcatttgctcacaatcgacatcataaaaacgttgatccgatagaaatatatccgtatcatcttccagacgtttagaaatttcgatattaaggggcgcaaattgttgtagctgagacgtgatgtacttggtaaaaacttttccattagaaaaatcgaccgtaatcttcacgacactacttaccaactgaaccggtagatgttccagcaaaattaacatgtaagtataatatagctgggttaacgtatctttatcaagccttaatttacgttgctcgcctacatacgccaaaatttgtttcaccatctcgtcaatttcgggataagtttcactgaaaaagggcaccttagttggatctacaaacgtctcactgaaataaaatggcgaaaatactttgagattggtttctagtagttcctgtcgaatctctgctagttgatcatccacttctaacccttcaaaaatttggtgcaaaaaatcgagctgtttttctaccaaagtttgaattacttttaacggcggctgattcccacacttttcgatttcaaatggcgctagttcgttgaccataaaataaatgttcagataccaagcttcttggattaaatcaggctcttctaacccccataaatctctcagtggctctagaaaatccaacttttccttagcgcaatccttatcgacaatctttttaaccacatttccctgacgaatacgcttagtttggacaaacaaaaaattcgtcaagcgttgccgttctgtgtagcttaaatgcatggattttagctcactcaactcggtgattaaagtgtccaccggctctcccagctcaatcggcatcgcatcaattccattgaaaaaatgatgaatcacgctaaaaatagtctgtcgcacactttcttcattgcgatgggtcttgttgaagaattcttccgacagaatttgcctaatataaataatattgcgataataggttgctcgactgattccgaattgctttaggaattgagcttgggtgccgtaaattcccaattgagaatttataaaaatattcaaacgaattgacctggtcgccatgttttccagaatggttttcattgaagttgttgttagaccatagattgacaggactcccttgccatcgtattccaaatcaatgttttcaatacgaagtgcagtaatcgttgattttagtaaatcaaacgcgcccagcacctgatgtctactaactcccagctcatcttgaacatagcctatcgaaagcctcttctcagaatcatggatatacagttcggctagttggaggaccaactgctgctcatcgtccaataatcggttaaacttctcgatcatattattaactccttaaggtgatttgttaacaatatttttaaaggcatcaaaatatagactctaaaaatatgtctgggggtaaatcatcttgggaacaaagcactacaccaaattatacaacaagagtagaaaatggctaattaccgttgtgttaagtatcgttatcgttaccaatacatttttagtttcgaccaccgcttgggcggctaaaacacctactccaaaaccaacctccccatctaatgctgaatcctatcaggcggacgctaattcaacgaccgtggctacgagttctagcagtacaaccacggcgtcttcatccgctactcaaagttccagtgcgacggctactaatccgccatctacagcaccatatcaccatcatcatcaccatcacgctacggttaccgtacggtatgtggatcagacgggaaaactcttagctaccgggactgccgattatccattcggcccttttgtaggccggccctacactacccatcctcaaaatattaataattatcactttgttcgcatgggagctggtagccttcctgccactggtattttaagccatcatggagacaatggtatagttacctacgtatacgctccagcataccacttgaccaccaaaactatcaacgaatacgttgagtatgtggatgaagatggtaaggctcttactaatccatatcgcgctcagcccgtcacctttgcgacggtagcagatgcgcttcatcacacgaccgttacttatttttcaagaactaaaacaactttaacgctcgatcaacaaggccgacccgtagaccagcagaattggactaggggcaatcaagctactttagctgccatccctaatccagctatcaagggttatcacgtagcttctaataatgcgccccgttctagccatcaacaggttgatcaacaaaccatcgatgctaatagttccgatttgcactatacagttagatacgaacagtctcataaaaaagctacggtaaaattcattgatgatcgcactcatcaagagctgctttcaaaagaagtctcggtctactataatcaggccaatacgtatgatccaacccgtaagatcaaggaatatgaaagtcaaggatatacgttaactactaatgacttccctaaaaatggcctcgattttgatcagatcaatggtgattcggtaacctactatgttcatctgcgatctaaaaaaccagctcaacctaagtcggatgtcgtgcaacctcttgcaccccaaaaacctagtagttcgcccaagacacctaaaaaggccgatccgattcctcaaccagcacctgtggttaagccgattcaatcgcacccagtaacagtaaccaagttaccgagcgccacgcccacggcagcgccactgaccatggaagaaaaacgggtcgtaattcaaaaaaggctccagcagcaccgcttgccaactgcggttccggccgcgcgccctcaaaaaaccgtgaaacctgcggcaaagtctcaggctcacatcgattttgaatacgtcgatcaacctcgtgttgcgcaaaagcgctggattaagattccaaattaccggcaccgctattggaaatttccaacatttacgacaacttttgccctttggaattcagaacttcaaccgctatatcgtaaaactggcgatgaccttcatcgtacccatctaggtttgattttaaggaccatgtcgggtcgcatgctgctcggtcaaaaatattctaaataagcacttaaaaactgtaagaagatcaattcagctagattctgctgcaatcattttcttacagtttttttgaccgcctagtcgctcaatccaaccacttatcccttacccatttacccgctctcttttttatgatgtacttagtaggaaaggatgatcgacattgaaaatgcgagttgaaattgatccaaatattaaagagggcgaagtcattattcgagcgcccgagtttactaaaaacattacagaaattcaggaattaataaaaagacaaaatgctacgcaaaaagttatgaccttttattccggttccactgaattttacctagaagttggcgttattttattctttgagaccgaggatcgacaagtccgtgcccacactgaaaatcagctttatacgacgcatcagcgactatacgagctagaggaaaaccttcctattgagttcattcgtatctctaaatcttgtattgtcaatgttaataaaatcttagcgttaactaaatcattgtcgaactgcttagtccaatttcaaaactcgcataaacaagtttatgcatctcgtcggtactataaatcattacaagaacatttaaaaaagttgaggtaattaattatgaaaaaatcacaatggttttggggcacattattcgttttagctgcggctgttttagtagcaacgcagatgggttggacggcgttcaccttaaatccgttctccgtcgtcgcttctgtatttttaattgctgcactggtcgtcaacctcgtccacttgtccatcgctggaaccatcttctcaattgcatttttattaatgctatatggtaaaccccttggtatcagtagtctcgtgccatggaccattctgttagcggccgttcttctaacaattggtctatcactaatttttcatccttaccgccgaaattggcaaaagcatgcactatggaagaattttcagcatggttttaatcatcacccagactacgattatactgaaagtacgcagtccgctgatgatgacgtaatcaatattgaaactagcatgagtagtggtattcattatattcaatctcaagatttgaaaagcatcaatgtaaataactacatgggaactactaaggtgtattttgatcaagcacatcttgaggattctgccactgccaacatcaattgccaactgggaaacatcacactatatctcccacacgattggaatatcgtgactgatattaactctgtaatgtctggcattgatgaacggggaattcgcaattctggtacaggcccaaccctttatattaaaggcaaactttacttgagtggtgttactttgcactacgtctaatttaaattaacgcccactttgattccaaaatagtccgcttgctaattgacaaaacgaacgtttgttcgtataatttacttatcaaaaagaggtcgattatatggaaaaattaagcggaattattactagtgaaattaaaagtatcagttactctcccattttatttcggtttaccctgacgaatatgcaagatcagcactacaacatgctgattcatacccatgctctaaacttttttcaacaagccaagatgggatcagctattgaagtatgggcggtcaaaaataatcgcaatcaatacgtcatccgacgttttaacgtctttgattcgcatgtcttagtataaatagctatcataaaaacgccatcccttcagcaggatggcttttttatttaccttcagattagttaatccatcaaaaaatccccagtgctagattttcacctaacactggagacttccaaaggggaaataatataaggttaagtacattaggtccctaggatgtgcctgtgatatggccctgccaatggttcgccgccattgagaatcatcttgcttctcgccactcagggtaaagtttttttacggttttgggagttgtcgtataatgtttgaaccatcccctgttggttgtgattcagatgattagatatcgtcgatgtcacgggcttcatcgccaatatcttctatagcaaagttcactaccagctactccagctctgggagagacggtcttcctgcgaccgtaaaaaagagtggagttgccatcgtcaaccttgctacccttcggtgaaatcgtcttaattcatttactccgcggattgctacttaaagcatccgcgtttgttttgtccacttgaccccccagattaaaatcgtagccgagaatttcaccgatgatcttttgacaattttcattcgattaaatgttatagtttaaagaacttgcttagccactttgctagtcccttaatcgtaatagctaatcgacctttcaattatctacattagatctttctcgcttaatccgtttggccagtttggacaattttgatatcctgagattagaaaaacagccataaaattagaaaaatctaacattggaacttcaagattattttcaataatcttgaaggggttactttcttttaataagtgtattatattggttatcctgatgtcttggcaaacaatacgcctccttaaaaacccttatttgtagtattctaggtgtttttgtactttttatagacaatcttaaactttacaaacatattgcttgaattaagtttaaaaatccgacaaaatgcatttttgtaaggaagaaattatctttaggaaggaggaattatgagaattgttaaattggatccttctttattaacatctcaagatcgatcatttattttaaaattttcattgcttgaacatgatcttctccacttctttgaaaataaagattatgaacatgcccacgaacatattgaccagttttttagagactgcgcacttcaagatttatcttccgaagtggtgctacagtctctaattggtttggtaggcggcctgaccaatatcagtttttttacccatctcaatatcgcacatttcttagaactccggctcgccttcatcaaatttttaagctcccaaaacctaaaaattgaagattttcgcgatattttgtttgatattgttcagacatttttttcatataacgacgaacccacccgcaacgtcgattttcctaaagtgtctaaacaggtcgccctgaccgcttactatatcaatatgcatcgttatgaacgcttacgaatcgatcagattttcgcaaccttaaacctggacaaaaaatacactctgactcgctttcgcgcagagttaggcttttccgtgacccagtatatccgtcacgttaaaatgaccgaagcaaagaatctgttattaaacacctcaatgtcgattggtaaaatagctcagattcttaaattttacgacaccgcaaatttttcaagagaattttttaaagaatatgcggtatcaccccataaatatcgtcaactaaatcgtttggtatagcgttcatcttcttccttcctaattacttccttattatccaaaaaaatctccaccgtcagatttttatctaacagtggagatttttcattttcgataattagtatgttcattcgatacaaaagaaaatagcccagaaattttattatcaaaacttctagactattactttacttgtaaggaagattcttatttactagtgtttaacttaaactgcgctttaattttggaattgttagcctacctaaaatctatgaaaatcatccattagattccgacccataactactgcccccagtagccctaattcttaccattcttcacttcttcccaagtgaatcattatcatcccagatctgtcgcttccccgacagatgtacttgctcaagtatttttttcttaccactttttacggagcttgattcaaaaccctttgttgcgatattgcgtgccgccttcaacgaagtcggacttcccctgttactgcttacccataaaatgcgtcatttcacaactcaattacatcccctaattgcacattgcgaaaatcgttttttgcgcacaattccgtgattaaccgattaattcctacaataatcgtacagtagccttacactagtggttatttagtcttacaagcccctccccttgttctcaaagaacgtttatccaccaccacttcaaggagattttcccaagaagctcagatcagtggtggtgcttaatgcctcacgacatcttggccctacctccatgagagacttgtaatattaaattttaagaatcatcctttcatttttcggaaaccgtgtcggtgcaataacaactgctgttattggtccacctaaaactgttcctttatttttaaagtttaaatttattggttatagttgagaccgctttcactcgttctctatattttatcatacttgcctacaaatgcctaatactttcaatactttttttgaaagaaatttacctgagcaacccacaaaaaaggagccagtatgcttttttattaataatggtacgaagccattctggttaccccatctatcttttgcgatcgttgtagttcggtatcatccatttcgaagctatcggagttgcccgctgtcccaaacagcgtaataactttcgatgctaaaacccactgttttccaaccttgaacatttttaaattactagatttctgatttacagcgtgtaaatcacccacaatattttccttacccattaaaaatattcccccgtttatattgaatttatatgcaaccaaacctaaacgaagtaagcccgcttccccggacgtacttagtgttgctataaaacacgttcttacttctggtattatagtattatttttcacaatattttgcaagcgtttgccgtaggaatttatcggtcatttattttacctaaccaaaaaaaacacgggtaaaatttacccccgtgatttttactagcctgtcctattttttcagtgctttggtatagtccatatcctcacctttaccgataacatataaggccttttttccgaccgcttttcgccacttataaatgctctgacgactcactttttctttacgcgcaatttctgctcccgaaagttgttccacataacaagctttcaagaaccgtttttcagctggcgtgcaaagtttgtaaacctcttggaaaagttgatcagacattatgcgttctacccacgatggtttatgcccccaccgggcttcttgtttctcatcatcttccagttctacagcttgcacgtctttctccttttgtcggtaacgaatgatgtccagcacccgccagtaaaccgcctgataggcgtagccgtgaaactgtcgatcgttttcctgcaagtcctgtgggaagcgtacgtatgctttagcgtatgccaaacgagcctcctgcaaaaaatcgtcaaattcgactgagcgagtgttaatgtgtaatttttttaatgcgccgtacacgattttttcgtgaccgtcttctaataagtgttctaatcctagtttaattgttctttcattattttccatttcttgaatctcctaaagtgtagatccaagggcccttggtcaattattaatactacagaagtcaaaaacggtttttaaggtgtagtttttggtccaaaacgtgtagttcatcccgaaaaaggtgtaattcgtcttttttattatatttcagttagaacatggcagtttgatgatagaaagtaaaaaaaccacgaaatgagttattgcggttctcatttcatggttttttacttaaattttatgcggtccgtcgactactttagcttcgtagaaatcagcggcataaccaaattgagcttggtacttagcacccactttttcgattaaatcggctacttgatcctgttcaaccaaagcaatcgcacagccaccaaatccgccaccaatcatccgcgcgccgagtaccccatcatgttcccaagcttcactgactaacaggtctagttctggaacactcacttcatagtcatattgaagtgagatatgagaagcattgattaaacgaccaaatagtttcaaatcgccgttatctaatgcttttttggcatccatcgtacgttgattttcaaagaccgcatgccgagcccgttttattaaagtttcgtctcgaatcagataggtgtattggtcaaaggcagggttggagaggtctcctagcgtgctgatgttgagttttcgcttcagacaatctaaggcttgttcacattccgcgcgccgcgtattgtactccgaattagctaacgtatgcggcttattggtattcatgattaatacgatatgctttcctaagtccagcggtgagtactcgtattccatggtattggcatctaggaagattgcttcgttgcgtttccccattttgaccgcaaattggtccatgatgcctgaatttaccccaatataattgttctccaccctttgtcccgccttcgccatgactacggggtcgactttaaaattaaattcgctactaagaatggtacccatcaacatttcaatcgaagccgatgacgataatccagcgccatctggcaaatcgccttctaggtagagttcaaacccatgatcgtagtccgcatgggctaaatcccgaatttcgcgcatcattcctcgaagataattgctccattggtattgcgggtcaaaatcgaggtggtttacgtcaaactccaacactcctacctctggaaaattaccagaatacattcttactattccatccgttcggcgtcgatatccgccgtaggtccctaaactgatggcgcatggaaagacatgacctccattgtaatcggtgtgttccccaattaaattaatgcgtccgggtgaaaaatagacttcgtccacatctgcatgaaaaacttctttaaacttatttgaaatcgtagttttatcgatgttcatttcagcctccataattagtttccgaatgaaagattttgaacgacgggtggattaacgagcgctccagtcgattggggtttgttctccaagaatttgttcaatttgggctaactcttcatctgagaaatcaagatgatcgagggcccgcacgttatcaatcacttgttgagggcggctagctccgataagggcgcaggccaaggctggttcacgaagattccaagctaacgccatttgagctaagctttgtcctctttgttgagcgacttggtttaatttttcaacggttgctaaggtttctttaacttgaactgggctcaaaaatggaatcgtagctttcttggcccgtgaatcatcagcaattccgccgagatacttatctgttagcaatccctgtgataaggaactgaaaccaacggcagctttttgttccttttctagcactgggaaaaggtcggtttccgcttgtcgattaaacatattgtaacgtggttggtgaatcacaaatggtgtatgcaattctttaaagatggctgccattgctgcggtttgttcaccgttgtagttagagagtccgacatataaggtcttgcctgctcgcactaattgatccaaagccaaagcagtttcttcaatgttagtttctggatcgggacgatggctgtagaagatatcaaagtagtccaagcccgtccgtttcaaactctgatcggcactagcaataatgctctttcgtgatccccagttaccataaggtccgggccacatcacgtaacctgctttgctagcaataatcatctcgtcacgataagcgtgcatgtcagacttcataatccgaccgaagttttcttccgcactaccgggttcgggaccatagttattagccaagtcaaaatacgtaattcccaagtcgaaagcttggtggatgatttctttttggttttctaacggatccacacttccaaagttgttccaaagtcctaatccaattgcggatagttttaatccactatttccaattcggttataaagcatttggtcataacgttgtttatttgcttgatacataaacacatctcctcgagtttagtcatttaaagataccgctttcatagggttttatcaaggtatttgcgaccattaccctaatttcggctgaatctttagaaatgtgtaacttatgtttttagtggcagttttagtaaaaaaagcgtaagctattttattgaaaaaggatgaaggaaggaatggatactatggtttcaaattcgcaaacatatctaaaaattttagctgatttaattaaaatcaaatctgttaacgatcacgaattagaagttgcagaatatttgcaggatttattccaagaaaatggcattgaggcaaaaattctcccacttgagggtcagcgggctaatctagttgccgaaattggggaaggcactcctgtcttagctgtttccggacacatggatgtcgttgatccccggaaatttggccgcgtgggataatgatccatttaccatgaccgaaaaagatggcaagctctttggtcgcggaattacggatatgaaggctggtttagcagctttagtaattgccatgatcgaattgaaaaaacaaggcttacccaaaaaaggtacaattcgtttgctagcaactgccggagaagaggttggtgaagaaggttccgccgccttttatcgcgatcattatatggaagacgcagcgggcttgctaattgcggagccttctaccgtctacggtactgcttctgagcaaaaaggttctttcgatattaaatttacttctaaaggtacttccgttcatagctctactcctgaaaaaggttacaacgctctagtaccattgatgcaattattgaatgaagctaatacctacttcgaaacgattccagccggagagatgggaccagtacgtttcaacattgacgttttgaatggtggtagtcagattaattccttacctgatttagctaccgctttggtcaacgttcgcacgattccagaatacgataataaccaagtggctaagcagattgaaacattcgttaaatcttacgatgcaaatggagctcaaattgatacagacttaattatgaatgaatttccaattgctacgagtccttccaatcagttagttaaaattattcagtcactaggtaaagaatatgcaggacgtgatattgtcgtggctgcaagccccggaattaccgatgcttctaatctagctaaggataagccgcacgattttccttttgctgtatatgggccaggagatggttcccaacatcaagttaacgaaagtttacctaaacagatgtatttagacttcattgaaatctatcaaaaattatttattgaatttctcgaaaaataatattacctactaaaaagaatcgttagcgataatggctgacgattcttttaatatgttctcattaggttattcgtaatctaagttgaacttaattcataccgagctaattttagacacaaaaaaagaaccttccaatgatttttttcaaaaaagatttccagccttcgttttgcacaacaaaaaaagagctccaacccccatacgacggcgtttcgtcaccatgttggtcttcactcttttagtttttctactataaataattaaaggtcttctggaatatcatcaataggaaccaccgtcatagctccttgccgataaacattaatgtgatgaatgtcgtgggctttgagcatatctaaggcatcccggaagtgatcttcatagtgcgctgcgtcatgggcgtctgacccaatcgtataacgcttgccccctaattgcttgtagatttcaattgcgtaatcatacaaaccaatgttgtggtatttgtacatgctcttggtgttcaattcaaaggccaagttattttgaatggcaactttaaagatgttagtgagcaggactccggccgtagtcgagaattgaccagacgtcaaacttaatctccgtaccccataatcgaagtgagctaacacatcggcgtcatggaattcgttgattcccttccacatcaactggtaatactgatccgtcacttggagcggatctaagtgcgagacaatgtcactcccaaagtctttcgtaccatcttgatggaaacttagtaacttaatatcgaacgtatggtgggctaaatagtctttaatcttatctgcttgtccggctgacatcccgatttcaattcctttatgaactcgtttgcccgtcgcttttttcaaacgttcaatttcggccacgtatttagtgtagtctggaatactatcatggttttggacttctggattgttaaattccaaatgttctgtggaaacaaagtcctgtccggccaacttcatgtagtcttccatcttttcatttgaatcaaacgaaaagcttgtatgcacatgctggtcataattaatcataattttgccctcctcgttctaaaatgtatccgttctctactactattttagcatagcaacgcattttaacgcttgtctcaacgcttggagaggatagggaaaatgattttaatcgagatcttcaccgtttgtgcgaattactttttgataccaaccaaaggaatctttcttagaacgttggagcgttccgttgccatcatcatccttatcaacatagataaagccgtagcgtttagacatttgaccagttccagctgaaacgaggtcgataaagccccatggagtataacccatcaagtttacgccatctaattcaactgctttttccatttcttggatgtgagctcggagataatccacacggtatggatcatggattgccccatcactttcgaccgtatcgtaagcccctaatccattttcaacaataaacattggtaagtggtagcggtcgtttaaccaattgagggaataacggagacccactggatcaattggccaatcccaatcactagttgcaagatatggattttcaaccgttacgtcttctggagctaagttttcatcaattgaccgaccttcaggaagagccacggtgttggaattgtagtaactaaagcctacataatccactgttccggctttaaggatttcacggtccgcttctgtaatgtctggacgataacccttttgttgcaagtaagtttcaacgttttctggataaaccccgttgacatgcacatcggagaaccagtaacgccgttgcattaaacgttcagccaacatgatgttatttggggctgcattgagcggataaaatggcgtgaaattaatcatgcaaccgatttggaagtctggattaatttcatgacccaacttaactgctttagcactagctactagttcatagtgagcagcttgatacatcgctgcttcacgattttcaccccccttgaaaactaaccctgagttggtagccatcaagaagtcattattgtacatactctgattattgatttcgttgaacgtcatccaatacttaaccttatctttatagcatttgaaacaagtttcagcgaaacgaacataaagatcaattacgtgacggtcagaaaaaccattgtatttcttaactaaatgatagggcatttcaaaatgtgccaaggtaattaccggttcaatcccgtatttcaagcattcatcaaagagatcatcataaaatttcaaaccagcttcattaggttcagcatcgtcaccattaggaaagatgcgggtccaagcaatcgaagtacggaaagcttttaagcctaattcggcaaacattttaacgtcttcacgataatgatggtaaaaatcgattccttcgtggttagggtaattttcacccggcactaccccatcggtaatcttccgcggtaccttgttagctcccgccgtcatcacgtcggccatgctaacccctttaccatctgcttgccatgctccttctaattgatgagcagccacagcgccgccccataaaaagttttctggtaattttgtcattttcatccatcctctcttttaatgagctttttctgtagaaagccttttcatagataagtttgaactattttccattttttgtatagctttcacggcaaacaaaaaacatattccgcagataaaacggaatatgttttatttattttgcagtgatttacgttcaggactaatccaagttccagaaccaaaaccaaagatcgttttaagagctggtacaaacgtcatgaccaccgtcacgggattgaccatccagaaaaagagcatataaagcggcgcaaaaataaggtattttaacttagcagcatgatggtccaaaattaaagccgctaataattgtaagaacccggccagtagctcaaaggtcacaaagataaaagacatcacgattccgtgaaagactcgttcgtaattccccgtcagtaagaaaaccaacatggtaatgataaaaacagcggtggtaatcataaagaaaaatgaccagataatggaaagggttgagtcaataaacatcgacatttgataacgatgcttaatcggatgtaagaggaacttcttaatattggtcaaccacacttcagttccccttgcgcccaacgcttacgttggtgataaagatctttaagggattcggggacattcatgtgaaagacaatattaggagcaaaccgcggaattgccccaatcatctggtgatcccagacaatactaatatcttcggtcgcccgattttgccggaagcctcccacgtcaatcagaaaactcttgcgatacaacgtgttggcgccactgtaggcatacatcgagtcgttaattgaagtttgactgcgtttaataaccccaacaatactcgaaaattcaaccgtctgggccttgcctaaaatcttcgtgcggttttgaacatccatattagctgttaccgccgaagtattcatatcccggtcatgcatgaaaaagttcatgtacttcatcaaagcatccggttcgggaatcgtatccgcatcattactaagaatgtattcccctttcgcaaaatacattccaatgttaaaagcatgcgccttccctttatttttcaagattttaatcgtccgcaggcgtggatattgttttctcaagcgtgctaagattgctcccgtttgatccgtcgagccatcgtcagcgactaaaacttcaaaattagtgtaattaatttcgttaaaaagataggtgatcgtttcttcaatcatgacttcttcattatgggctggaatcatgatggtaattaatggttggtccgcaggtagaatattttcccagccttcatcccgtttatgggttttcaaaaagcgatacgacaatgagcctgtaaaccagaagaacgccccgattacaggatataaacaaagtatcaaaagaataatgttaatggtcgtatcaatcagggatcctttgaaaatactatcaataaagattgatgacatttttgccccttatccaagatcgtctaaattagatgctcgataaatttctttaatttcgtctgtatccagattttgttctggttttacttcgtagtacctggtattttcacggaattccttactgccaaatcgggcgtccataaatgcttctaatgtatcttcccgtcgacgctgattaattggattgtaggtaggccactgttcagccagccgatcccgccgccgattttgaataatcgtcatactcgtcgcaaacaagctcgccatgacaaatgcaaaggccaataagattccgataaatttaatttcaaaaattccttcactataagaccagatatgcggaatctttggattataaatcgcccaaaaggaagtgacggtgatgatgataggaacaaacacacacatccaaccgaaaatggcgactaacgtttgccatattttcaaccaccagtgtcctttttcaaaatacaaatctgtatatagctgctgacgttctttttcgtttttcatcctaaacctgctttcggtaaacatcctccggcttgccaaaaagatagccttggcgcgcatcaatctggagctgctccgctaacgcctcgtcggcttcattttcaattcccactaaaaccaatttaatttcattttcttgggccaacttattccaaaattggagattaagatcgagccattcgttgggatctttctttctaaaactactcatggaagcctttaaaacatcaatttcgcttagtaaccactcaatatgtttcaagtcatttaaagatgaacctacattattaatcgtaaattgaactccatagctacgcccaatctggattcttcttttaaaaagacggcgattggttagccgattcatttcatggattgaaagttcaatagctaaattaagtggctcaattttcgcaattgcccaccgcacaaagtattcaaaagccggactcataatttggttgtaagttaatttaatagaaagggttacatgctcatcggctaaagattggaaagtcgtctccagtaagctaatcacgcgttgcagtggtagggattcaaaatcacgtggcaaaacccactgtcccgcttcattttgcgtgcgcaataggcactcgtagccaatggtattccccttacgatcaacttgtttttggataaaataacgaagtgggatttcatcattccgtaaataatcgctccccttattccgggtccaccagtaatatccaccgataattccaatagtgatagccgccatcagcactgtaatccaccataaatatatttcaagtttttctagtgtcatatcgttaacctttccgtttattttaaaactaaaaaaaacgattggcattaccttttggcgtgattttaatattttttaaactgataccgtttattattaatgatgataagcaatttcatattaaaaaacaacttaatttagcaattttgtacaatggtggaatgtgctgtgtaatactgtttcatccgttttcaatcattattaacttttaaagttctaagtgattgtgtaatcattaacatagtttcacagtaactaaaaagtagaaaataaaaaagctgtatagtaatcgaaaatcgatttctatacagcttgctagaattaactttaatggttaggcaatgccctgaatgaattcttcaacttcttggggagtacggcgttcacctttaccaaaacggccgagttccttaccgtcttcaagggcgataaaacttggaatacccatcacaccaaaatgttgagcaacttctagattgtcatcacggtcaaccgtaatccaatcatattgatcgtacttcttcatgatgtccggcattgcgggcttgatgaaggcacaatcagggcaccagccagctgtaaagaataacattttcttacctgaattcattgcttcaaaaatttcttcgttagttaaatttgcttgagtgctcattttgaattgctccttttattaaaaactagcttactttttgtaagctgctatctatatcaaatattctatcagcttccagtcattttgacaaccaattaatttgcccaatttaactcctcaggcgcgagttggtataccttgtccgctcgataggaattaatcaatttaaaatcttgcgctatgtatttttcatcccataaaaattggttaatttcacgtgaaacattttggcttcgatttaactcacagtgatagccgtcgggtccaattaccatcaactcggaaactttggctgccaccccatcgaggaggtagcccactgcgcgggccgaatcaactgccacatagacaattccatccacgctcccaattacgtttaaaacttcagcccctttaggaaacaagtggcgattacgaactagctttttaaaatgatgggttcttttattaggttcccaacttttggtcattacatctttaacagtatcctgtgaaagaaatccatgtaatccattgaaaggacccgcaatggtcactaattttttcaaagctggtaaacgtgaatctttgccaaacttaatcgctaaattaaccaggacattacttcctagcgaatgaccgaccccattgtactgttcgactccaaaactttgtcttaatttaattaataactggtgcatccaactaacttgccggcgttcaggagcccgattgttttcaaacaacacctgaaccatcggattagcgacctgctgatcgagttcgccatcaaaatccattgccccatcatttttgattttgaccaccagcatcttttgcgcccagccatttttctgtgctccatggatcaaatggtccgtagaatccgcatttccattaaatccatgcacaaaaattgttactgcattcatctctcactaacgctcccccacttaaaacttgcatcatccattctactacaaaaatattaaaagggctgcgcccaaaagaaagattactcttgagacgcagcctctttatgattaaaccaaaatggttgtttggtcatccatattttcaagtcaaaagcttgtaatggtaaatcttccccattaacttgaccatgttcattttcaaaagcttgtacgtgaatttctcgtccagttttaaagaaaacatccggcatatcgagatgctttccaccacgtaagagcttaataaataacttaacaaacttgaaaaaactcaatttttcagtaattaccacgtctagttttccgtcgtgtaagttagcgcgaggcgcaataccgacccctccaccaaaatatttgatattcgttagtgaaacgacgaaggcattcacaaattcatgacgctcaccgtcgatatcaatcgtaagtgggaatcctttttgacgcattaacgttttgaggagggccgaaacgtacgccatcgattctaagtgccacttgctcagcctaactttctgaccttgatttgcttcatagaccactcgggcatcaaagccaatcccaatgttgttggtaaaatactgggtcagttggtttgcttggttctgataagctccaatgtctaaggtaattggggcggtggtctggattaattgctgtaaggccgtggacggatcaggggcgatgccgactgcccgtgcaaaatcattccccgaacccgctggaacatagccaatgggaacggtgtttttagagcggcgcactccattcagcacttctaggagagtgccatccccaccaatagcaacaattacccagccttgcggatgtagatcggcaaattcttgggctaactgggtcgcatgttgggggtattttgttaccacacgttcgaagttaacagcgttttgcacgagaagttgatggagctgttcccacgtctgggctgaatggtgcgctcccgcccatttatttacaataaaataatatttaatctgttcattcatgctagtctacatacttctccaaaaaatttgctacctcgatttgatagcgatgcggattagttgggagagcttgcacgtgatcggcttggtcaaccaaataaacttggctaggaacacgagctgcttccactaaatcatccagcatttcgattggaacataacgatcggcttcgccatggataaacatgatcggaactcgaacttttttaacctgttcttgaatattagcttctttaaatgagtaaccagcttcttttttggttaatgcactagcaatcgcctcaaactcttgcgatggtaagtggtagtagcgtttcaaacgatgtcggaattgtttgtctaaacgattaaaactactatcttcaatcacagcagttaagttagtcgccatatctggttcccctgccgcagaaatcacggttgcagcacccatgctaatccccattaaaacaattttttcatccgtatgggttaataaaacagcgcgttgaacccaacgtacatagtcgcggcgatccagccacccaaacccaattaggttgccttcgctttcaccatgactgcgtgcatcgggcatcaaaacgttgtaacccatattatagaagattttggcatacggaatcatttgcattcgggcgtgatggtatccgtgggctaaaataaccgtctttttagactgtttggcttctggttgtcgtaaaaatgatgctcgcaattgaaggccatcttcactaagcatactaatttcttctggttctaaattattaaaccattcaatattgagggcattattatcttgagattgtgaacgttcaatggctttattcttagctttttccgtatttttaatcccaactaaaaaactaatatatccgccaattcccattccagcagtaattccgagagctgcggcacctaagccagctaacatatatttagtacttttattcattaataacgctccttatctttagccaacttgctaaaaaacattatccgttaatggtaactttctctcattataatatcaatttttgggttaaaagtggtatgataaacgtgaaaacgggtccgtagctcagttgggagagcacctgcttcgcatgtagggggtcgacggttcaagtccgttcggatccattgataggttacagaagtgtttaaagagtaccaaagtgaataccccatggtttttagatgtgcgtatctctaaaaatcatggggtattttatactctataaaaaattcatcactatgacaacaacataggcagtttacgaccatatccaacccttacacccgttataattactgttcttccactacctatagtttcccctattaatccaaattgttatccaactttctgataactttcgctggcactcctgccaccaaacagttatcaggcacatctttagtaacgaccgcacctgcagcaactacgacattattgccaatcgttactcccggtaaaattgtacaatttccaccaatccaaacgtcatttccgatggtaaccggcgttccttgcgccatcttttgtcgacgttgcttgggagacatcggatgattgaccgtagcaatcagcgtgttgggtccaatcatgacataatcaccaattttcacgggcgcaatatcaagaatcgtgacgttatagttggttagaaaatcctctccaacatgaatatttttaccgttatcacaattgaaattaggctgcacatatacgtttgccccagttgaaccaaataaatctttaattgcggcttgttctttttggtcatccgttggatcaatattattgaatcgcgcgcacttggttaatgctgcttgcttaagcttggcaacttcttcatctaaaaagcaatattctaaaccttgttttaacttttcaatctctttcatttttacctcattactaacctagctgaacgtgagcatctgccaaagcttgctcaacaactcgaagcacctcttcactatgttgaagacgtagagcggcctctttcaaatccttttctgcaataattcgttgaaataccttgaattcttcatacatgcgatgcgaattttgtttaaaatcaaagtttttaacccctgctttactttcaatatcgaagttatcaagaacattggttgctccattcacaattactgaacccttcgtaccttgaattgtcgatcgaatcgtagccgtcgaatctttagctccgatacaaaccactttggtattaggataatttaagatcaatattcccgaagtatcgatatctttttcgatattggctagatatttgacgcttgatggggcgcccaacagacccacaacaaaatgaatgttataaatattgatgtccatcaaagccccaccaccgaacttggggttaaaagctggtaggatttcacctgctttaaaagcatcatagcgagatgaatattgcgaatagttacattcaatcaccttaatttcgcctagggttggaatggcttctttaattttttgataattcatcatgtattgattggtgatagcttccagcaaaattaattgcttcgtttgggctagttctgctaattcttttaactccgctaaattcaaagcgaacggtttttcgcagataacattcttaccggcttcgagggcttttttagcaaaagcaaaatgtaaatgattggggacagcaacatagatggtatcaatttcttcatttgcaagacattcatcgatgtccgtatatacacgatcaatcccatattgcgtttgtaatttttccatattatctataccattgggggttcctgtgatagctttcaattcaatctccggtaacaacggcgtcattgtaagaaagtcctttacaatcattcctgctccaacaattcctaatttcatcgcatgctctcctatttatccttttaaaactcgcttttttgcattttcttgatgcctgtttctagcatttttatttgcaacaaagtttcttcatctttaacagttttttctttaccgttgataattgcttcgtacaatccctcgtataccctgctgtagtccccgacttctgagacaaccttttcttcatggtattttccggaatcgtctaagtaggtcaatactccatagtgttgtggcaggtcgattccaaaatcgggatggtctggcatataaaacatttttaaatgttcctcttggcgatctttggtctgtttaacaaacatcccttttttgccataaactacgaaacttggtcgttcctttattctgaaataactcgatttaactgaaaccttcatcccaccatagaagagatccaagtcgaaataatcattcatccgattttcacctagtagttgtctaacctcatagtgaacgttatccggttctccgaagtatgaaattacttgatcgagcgtgtggcaagcatgaccgtataaatagctggtatctagtgaaaattcttttaccccttccggaacctcggggcgatagtaatcgtagtgcatttccacctctaaaatatctcccaaaacgccactctcaatcactttttgagtagttaggaaatctgaatcatatcttctattctgatagcattgaaccaacaacccttttgattttgctaagtcaaatagttcttttgcttcttggtatgtttctgtaaaaggcttttcaattaacgcatttttaccatgttccagcactgctttaccgatttgaaaatgcgagctactgggcgttgatactacaaccagctgaatttctggatcattataaatgtcattaatgtcggtggtataatgtacgccttcgattcgtttccacgtagttgttttcgtacgagaataaatggttttcactttaattttgtctttgagtttgagtgaaaatggcaaatgataacgattggcactttttccatttccaatataagcaattgttagcatcttagttcctccatttgtattcaaatattgctttgctatctacaatataaaacggggaacttttaaacgatatactttagggtaattctggataatactttcagaaaaatagaacttgtactgcttattcctaaaaaaaattaccaaaatcatgatgaaaatgttttttaagctatactgattatgaataagccaaaaggaagtgagctatcatatgctattaatcgacaagctgagcaaccacgaaaactttaccaacaccgagcaacgaatagccgattatattcttaaaaacatcaccgacattccaccgatgaatattgataaactttctaaagtcacttatacctcacattcagccgtggtccgattgactaaaaaattaggtttcgaaggatttaaagattttaaagtagccatttcagaggctgtgtacagtcaaaccgccaacatgaattctgttgatgctaactttccgtttgattctaacgattctgtctctaccatttcaaagaaagtcgctgaactctctgttgaaagtattcaaagaacatttgcacagttagacgaacgactgattgaagaagcagccaatacgattgccaaatcggaacgcattttcctatttgcgcagggtgattctcagattcgagcccgtagcttccaaaataaattggttaaattaaatcgtttcgccattttgggtgaagaatacagtgatgaagactggacggctgccaacttaaccaaaaaagattgtgctattttcatcagttatggtggtcgtattccacaatatgaacgcatgctgactcatttttccgagaataaaattccttctgtagttctgactggcaatcaaaaatcgcccctcattcgtttggcgcaaactgcgatcgtcactactcaaaatgaatatgactttttaaaaattagtacattttcttctcagatcacttttgaatacttattggatacaattttttctgttatttatgctaaggagtaccaacaaaatattattaatttaaaaaataagtttaacttaattcaacgtggtactctttctgaaggtttagctaaggaacatgactcaaagtagtgcgtaaaatgattcaaaaaatgctccggaaaggttaactttgtagttgctattttgcatttataaattttcaatacaattgatataacaagcgtgaaaatgggtccgttattatgttacacgggtgtttacaggttccaaatcaaacggctaaaaaatactaaaaaaagggaatcaattcgaaataaatcgaattgattccccttttaatttattaagatccgttgataaaagtccctttctattctaaatcaaaaggtattcttcacatttcttttagcccttgaatggccgaatctcttgtattaatttattaaatcgtcgttgactagctagaccggttctactaattcgcggtgagaattgtcgatcaaattcttgagcagcttgctcatctatctgatagcaaggatgttcgaagtattttccagcaaattcctctttagtgatgttttctaaaggataaatttggcaagctggcatataaacattgtcagcggttctaattccatacgtttcagctggcacaaagcctttacgacgatatatttcaggatccccgtacaataatattgctctgaatttagcagcttgagctcgtttgatggccgttttaattaattgacctccgatacccaagcgttggtaacctggtaagactccgatcggacctaagctgatcacttccaattcttttccttgatcagtaagaatcacagttttaacaaaaattacatgtccaacaattttgtccttgtctaaagctaccaattctagttcgggaatatattctggtactttacgaatctgttgaaccatgtaatgttcatcgcaaccgggtgtgtaaacatcccaaaaagcgttccgaataacttcatatgtttccataatatctttttcttcaattgttctgattttaaatgtcatcttttcttcctctcttgatttcttttccacgttcaatatatttaattttaagattttgagctctaaaggcgttttggatttcttggcatagtccttctgcatctgcgagtggctgacaaacaaataggtcaacagcagcataatcatattctggccatgtatggattgtaaaatgagactctgctaaaactacaattccactaacaccccaaggtttaaattggtgaaaataatgcttaattggggttaaccctcctattttcaccagcgcgttcattctaaattctacttgctttaccaccattaaacgtgttttatcacaattctctaattctaataaataatgatagcctaagggagttgttgaaagtgatgaattctgcaattgtttcagttgccgttccacgcccacataagttgttgaagtttgattgagatttgagttagctttaactgcccttgtatacaagggatcatgaaaatcttgctgacttttaattaagggcatactggctcgagttcgttgtaagatatataaattactcttatttcctaacacgcttgcgccatcatacaaattgaattctcgtaaaatggtctttactaccagttgttgttggtaaaacaactgttggatgagtaagtcggttgtgggacttttttcaccaaatgaaagataaattgtttgttcctgtgtttttagtgctgctagtgctcgagacaaaaagagttttaatccagaaatcgtataaggtggatctgtcatcactacatcaaactctggttgaaacaattcaagatgacctttcgttaaatcgtgtttaactactcttacctgaagttggtagatttcagcctgtttttcaataaattcaattaacgctgaatcatactcataaactgtaagctgagttttatagccttcatgtttatcttttttcaaatgctccagtaaaatagccgtggttaaactaattaaatcgtcatcgccaagaaacaaaatatttttgccaattagttggcgttctttcaataataagagcgcccgtttgatggccgtatcaatggtacaaaatgcttgatccaatttcagattcacatgtggacgatcactaatgatttcacttaattgatttgtcatctcctccacaagttctgattgtgcggggccatccttctctaactgttgatagtaagcaacatcaatatttgcccatcctagctcatgttctacatataaggcaccacgttggctaagcataaattcttgttgtttgttaactaacttcatccttgccaattccttacgaatagccgatacgacgggaattggtaactgacttgcagtcgacaaatctttgagagtgctcctttttttaaggtacatttgtatcaatatttgctgaatagcatttgtttcttcttgtaaattaactttcttcttaattgtgtctagtatggtcataattatctatcctaaaatgatttaggttttcacctctttatttttttaaagtgaaattctagataaaaaaaatcaaagaaaaaggtgaaagcatctcaaaaaacgacactttcacctttattatttcattagcatgaataaacaaaaatatagtttagatgaattgattgcttttgattatctttagacacaagcaaataaacctgatccaggagatccaggaatatactacttgttaaatttaatttatctagagataactaccgcgctcacaaaaaccaccctataattttttatttgcttattcctatcaataaacatctaccactaattatacggttttacaagctatagtcaacaagacctcgatcactataatactgaatactcatataaaagtgcgtaaatagcgcatttacatcgagtatagacatccctcaattctatacaaataattacgtccaaagtccaaaaaatacgcctggtagtttccagacgtatttttttgagaacatattttagataatgtaatcacaaaattgaactaataactttagggaatcagttcattcatcaactggtttgttaaagtcgttaattgatcccactctggatccgtttaggtagtactaatgttacaattgtgttgcaattatgtttcaataagattattatatgtttgttcaaggacaactaataaataatatatagaaatggaattaattttcctggggggtattatcatgaaaaaaggatttgttattgctacagtagccatgagtttaggaattattgcaccattatcacaggtagtcacctcaacaccagtctccgcaaaaacaactagccattcatatgtaactacaacaagtaattctatttcagtaactaatatcagaaaaggatccacagtcgtactcaaaaataatatgggacaaactattgcaactaaaacagctgctaatgctgggacagtcacatttaatttaggaacacagcaagtaaaccgattaactaagactgacactttagcaattaaactaagttctggatataaatttaatatcaattttaatttcattaattatagaaccccagccagtaataaatttgtagatgggattccaactgaactacagggccattggcaagccaaattagggtatttcaccggtcattggaatatgaccagtaaccgctcaacattaacggttaatgatcctcaaattttaaataatgttcagtacaagaatttaggcaatcatacttatgtactaaaaggtactgaaagttattacagcaacggaagtactatccagtacacagttaaaaaggtaagtaacaaccacttaacattaaccactgctaatggagtatcacagtggtataaataatactgtatggataaaaaagtctaacttatggaatcatcccactaagttagacttttttattatattcttactgaaacaagttgttctacgttttgctattcttcaaactactaatgtgtgtcctgattttgatcatcacgtggcttagtttttgccaaaatatattgctcaattaaattaatgatttgttgattttgtggtaagtcagaatgttgagcatcatttcctgtaactgtaatttcagtataatgttgggcttggccctgataaatatatttacccgcttctgcgctccgtgctggtacaatcccatcattatcaaaattctgagtaccaataattgaatagactgacaacgttttaggaatttttttacgttgtttaataaagtctgacagcatctgagttttatgcgaaagtgacgtttctgagaaattataaggtgatccaatggtcattaacttcttgattgaaatatcgtcacgattgaaataattttcgagatacattgtatagaccaaaccaccatttgaatgaccgatggccttaaaattattaaactgatattttttagctaacgcattaaacgcaatagaaaaccatttagcttgttttttaatattgctataaccatctttattgttctcaaaaccaacaacaataaacggctcattatcacgtggacggatcgatcccgagtaactaatccgatcattagtatggaccgttacttttaacagactatggcgcttcccacgtctatcgtttaacttatcaatcaacccatcaaatcgattttgcgtagcactactccccggaatgaaaataaccggtgacatatttgagtcatgtcgtttagaaatggcggtcacatttttatgcatccactgaattgatggccaagccaatattccaattcctatcaaactcgcaattaaaaatataatgctccattttttaacgttccgtggcatctagaccatctccctgagtattaagtcggttggataatttcacaaatggtcgatacagccaaacgccgattcctacgttaagtaccataaccaataaggttacccaattcccattggttccaataagggcctgcaaaagactgggcgttcccaacggcacttgataaactacagcaggcattaaatgtaaagcaatggcgcttgcagcgattcctacgttaactagtggaactaatagaaatggaataatatatagaccatttcctaaaactggaacacccactaatatcgcactattaaagttaaataatactggcagcaacgaccatcggccaatcagctgttgatcacgttgattactgaacaaaaaaattgcaatcactaatgagagcgtacttcccgttcccccaatcgcaccaaaagattcatataacgtccctaatgaaaaaggatacggtactccccaaatcgtgtgatgtataagggcatagtttaaattcgcagtcattgcgacgccattacgtccaaaatgtgccagtattggcatactggtcaacccgaaaaaagtcattatgccagctaatagtacgattgctacggaaaatagcaacgaggtttggttagcctttagtgattgtaatcttaaaataacttgatctggtaaaaccgaaatcgccaaccaatttaataaaatactaaagcaaatcgccacaaccaacacaattataattgctcgtaatgaatctaacgcacgattccatgttactcccgaagaagatttatcctgctgctggctatttgctaaatgcttaaaacttagtccaaccagatagcctaccaaaaaacctaaaaacaaacctcccatcccaagcatatcttggccaaaagctaactcaccattatttgtataacgaaccgtaaggattaaataagcaattaatcccgttatactcgctaatttttcatcacgctgataccgtttggctgtataatgtgccatactaaatgcggctaaagcagctactattcctaacgttaaactcgtcaaatgatcaaaaataatttctatgaatcgataccgacttagccacgacgaaaacccaaaaattgttggcaataaactatttcgattcaacatagtgatttgaattagttgactgatactaccgataagaacaaatgggaataataaatttaaacttttttgcactaattggtataactcattttgttggagccgtattatttttcgaataatttgttctcttcttacccacattagattttccttctttaaactaatctctcctactattatctttattctagttgaatcattatcgaattgcacaccgcgttgctattatttatatctaacctgataaatttggttttaaaaaacacgtctgaaactatcaaacgtgttttttaatagaatatatttaaatgcttggattattgctttaacgactcgggtattaaatcgctctctataggttcgaaaatagtatactttcctacttcttataacttatcttatttttcattagaataacgtgccctcaacgcccataaaattgaaactgtatcaatcacttcttggaacatcgctccaataaatgccggaataattccaaaagcggcgatcaacattaacgctgtacagataaaaatcccgattaaaacggcttgccgagcaactcggatggtatcttttgcgattacaactgctttagctaccttagctaggtcatcttttaagataaccaaatccgccgattcactggcagcagacgatccatgagctcccatggcaattcctacatcggcagttaccaaactaggggcatcattaacaccgtccccgaccatcaccaccggcttttcttccggagtgagagcttttaatgcagcaattttatcttctggtagcaattcagcttggacatcatcgattccaacttcttgaccgattttttgagctgttttgacttggtcaccacttaacatcattaatttcttaacgcctaagtgatgcaactgaaccatggtctggctagcttctggtctgaggtagtcggtaaaagtgatacaacctaagtattgatcatcccgactgacatagatagcggtatgggtttgactcgggattaaaggatctcctgttacaaatttacgcttaccaaccttgactaattttccttgaatcaaggcctgtactccattcgccgtaatttcctgggcgtcactaacacttaacattttcagacctttatctatcgcgtaagttactaaggagcgcgccaatacatgtgaggagatagtttccacactagcagcgatttggagcaattctgtttgggaaacttcttgatgtggcaaaatctccgccaccatcaaatgcccattagttaatgttccagtcttatcaaaggcgaccgttttagccgtagataatttttctaaaacatccccggtcttaaccacgatcccattgcgagaggcccgactcatccccgaaaccatcgccactggagccgctaagattaaaggacaaggcgaagccaccaccaaaacttgcgcgattcggctaggactcttagaaattaccgcggccaccaccgcaattgcgattgccacgatggtaaaaggtaccgcataacggtctgccatccgcacaaaacgggccggcgttgcttcagctttcttaaccaacttaattaattgttgatacttactattggcggccacctgactagcttgcatggttaccacagcatcaccattgactgaaccagacatgagttcatcgttaaagtccttatttactggctgtgattctcctgttaaagaagattcatcaaagtttgaacttccttcaacgataaacccatcaaccggaactaattccccaggtttaatcaccaacttatcatctacttgtacttgattaacagcaatatcttctagtttttcaccatggagccgatgagccacttgcggtgaattatctaaaagggctttgagttcagtattggctttcttggaagcatagtcttctaaggcatccccaccagttaacataactaaaatcaccatggctgcccagtactcactaaataaaaggctcgaaaccactgctaaaatagctaataaatcgaccccatatttacccgatctcaaagtcccaatcatctcaataaacatggtcatcgccatcacggctcccaccaaggaaaccagaatttgggctaaccaagcttgacccaagacaaattgtaagattaccgccaaaagtgcaatcgcaataatcaccatcaagctttgtttatgactcaattttctcatattgatttaccattcccctcaatgtaattcaatcatgatatctatattgctttatctcaattatactgcttattcatgccttatttctggtaagaactgttctatgtttattagtagaatttatttcaagttttactatacaaatcaggttcgcaaaagagtataaatatcatgtaacgcaaaaaatgaaacgggtatataatatttaaaaagaaataagaggaatgaaatgacttctacaaaggtgattattagagaagcgcaatctgaagatgctcaaggtgtactaaattatttaaaatttattactaatgaaaccagtaatctattgttaacaccagaagaaatggctcaaaagaagcttactgatgagataaatcttttagaagaatcatccaagtcctccgaaaatctttttttgttagctactaaagatgaaaaaataataggtacagctaacatgaaatcatttttaagaaagcgaattagtcatagagggacctttggcatatcagtcttaaaagaatttagtggtcaaggcatcggcagcatgttactagcagaaataataaattatgcaaagtctattaacttagaaattttagagttagaagttagaacagataatatacctgcaattcatttatataaaaaatttggatttaaagaatatggactatatgaaaaattttttaaaattgaccataaatattatgatgggacacttatgttattagttttaaactagaaataatcatccaaaaagagcaccaccgcgttttagcagtgatgctctttttattttatcttaattattacgaaattaattttaattctacctattttgaagtatccagataatcatcccacgcaactactttattatccttaacagtagcaatcgacaagaaattcatatcaggtatacctggtttaaaccgcacaacgtattgcatgataatagtcgtttgaccaggtgttgagagatccttatataaattaataaactcagcggaagatcctgaattagtattctcttcaagccactctttatattttaatttgcccatttcctttggcaaattaggaaaatagtaattaaatttaaatactgcgttttcatccactgcatcccaaaaagtttcggcatcaacgtggtcttttaaaccctccatcattaaatcaaaaactcccataaaaagcttatgtattagttattttagtaatttctgatactgtgatcctctcaaagttctaattttgtagttgtttaataaatgtagccataattagcaaaaaaatttgacaattaaatgttaatattctaatctaaatagtaatcattactatttagattaggaggtgatctaataatgtaaatttttatcatttatttagcgatatgaagaattaagcataagttgtataagtcttttagtatttattttgaattttcataaatatgcttttgatgcaaatttcagaaatacataaagcagttgaccatagatcactttattaaggagaaaaacatgaagaaagaaaatcaatcaagtgcttataggtacttaaaaagccctaacgtcaaaactaaaagaagagctctaaaaattattaaagaaattaaaaaaaataggactaataaaagatagtactttttattatttatacttttatagatttatttggcatacattattaaatttaaatttaggagtagatatgaaaaaattaataaaatttgtaacgctagtattcgcttttaccagtaccttaatactaatggctggctgttctcaaaataattcgtctactaaagatggaaaaataaaaattaccacaaccaccgatttttatggtgaagtagcgaaagctgtggtcggtaacaaaggaaaagtgacatctgccatcaatgatcccaatgttgaccctcacgattatgagccaacttctaaaatagcgaaaaaggtaaccaattctgatgtattaatcgcaaatggagttggttacgacggttggatggataagttagcccaaaatgcacataaagctacttatattaaagttggggaagatcttttaaataaacgagaaggtgacaatccacatttatggtacaatccacaaactatgcctcatcttgctaacgatttagcaaaacagtttggtaaattacaacctcaaaataaaaaatattttaaagttaacgcaaaaaaatatattaagtctttaaatgcagttaatcagcaaatcaagggtatcaaaaaaattactaataatactaagaataaaaaagcttacgtgagtgaaccagttttcgattatgccttaaaagctgttggatttacagtagcggatactgattttgaaaaggatacagaaaacggtgtcgacccatctccagctactattaaaaagttacaaaaaaatattaaagagcatgatatttcgctattcgttttcaataaacaggtagattcaaaggtagttaataatttggtcaagttagcaaagaaaaatgatattcctatactccctgtcacagaaaccttgcccaagggagaaacttataaatcatggatgcttagccaatataaacaacttcataaaataattagcaaaataaatcaggaataatagcaaaattatatatagtacctgctaattccgtggaaacaaggtacaaagtataaaaaggaatccatcactgagtgagtgatgggttcctttttatactgcattaatcaattttgtataattatgaattctcatttgaacaacttaagaaaaaatttttctcttatttgttagctagtatacgtcgttttagttctcgtgtcttggttattgaacacttgcagcttagagatgaatcaaaataaatcatctttgttgaagcattgtattccgatatattttttatattaattaaagctgatctggaacaacgaaaaagctcggtgtatttcttttcgtagtcttggagccttccgtaaaattcatatttaccacttttggtaaatagatttagtcgatgtgggattttagcagtttcaagtattaaaacatcatctaaatcaaaattgaacactcttactccaatactgaaattaaagatttttctttttaaatttttacgttcatctgaacgaagccttgctaaattgagagtttcatagatttcatctcgtattttttcaagggagttatctttgctgatgaatcctaaagcttcaacgcgtcgctttaaagttaatgaagccatttcattgtgactagtaataaatataatttcagattgcacatctaattttcggatttgttcggctagatcaataccattcatactagttcctaagtcaatatccaaaaggtaaataccattttgaatattatgacttttaagataatctaagcacttttcaggattgggagtactaaatgatttatcaaaatcttcttcatggaaaagaacaaaatttttaatagtagtactaatcgcatgaagttgagttgggtcatcttcacaaacaataattgaatacataactacctcctttcaatattaattaataatgatctgggtagtaaattggtagttattagaggaaaaatgaataaataaattaggatacttttgcttcaaatcttctacaatggacagtccaagtccggaatgattggatttactagaaaatccgatttttattaactggttgatattggaggcagaatgcgcaaccgtattcgttaaagtaatttcagttgtattatcaacatttttataaattagaatgtcaatatttttttctgaactttcaccggcttcttcaatagcattgtctaataaaatacttagtagccgaacgatatcaataatatttaaattaatttggttaattggagttttacattcgaaatgatagtgaatttgggactgttccatcgtaaaaaatttattaagtaaaaggctttttacatgagtatccttaatattttgaatatcttgataatcatctgtatgttgttggagttcagaatcggaataaagtttcaattttgataaatataaaatcaaaccttcattgtccccttctttagcgagttcggtgatgcttaacaatatatttttataatcatgtttgaattttctaagttttaattgattttgttcaagttgcttagtataggtttgtaaattatcaaggtgctgtttttctagtttggattcatatctctgacgacttcgaagatttaaataaataaaaaggcccaacattattaaaaattcgatgataacaaaaattaaaactccgttaataaacgtatcaaacattccatagtggtgcgcaagaacggtaaaaaagtaaaggatcgtttgaaatataatttgtacaactaccaaaaaaaattgggtactacgatcccacaatttagaattgtcgattttttttatatatataccaagtgtggataacataagaatttcaaaaacacttgttacaatcatgtttttccagtcataaagtttagtatggaaaagtgtatttgaaatactggacgctactagcccagaaatattaactattagataagatagcagcaagttatttaatgtaagccaatcatagtgtgctattttaaaaactgcataataaatcgggataaaaacatatataacattgaacggtaagaatgcatatagtacaaaaaaaagaggaattgaacttagtcccactataatttttggggtgaaagtagataaatgatgtgcataattttgtagaaatgaaaaaatgatataaaaactaaaaaaatcaataaccccttcgaaaacgtaaaccttagtatctactgaaatcaaatccaaactcccctttgaagtagaaaattaaccacaatgtctaaacaaactaaaaatacaagtagtaatatttcccagcttttctactgtgaaagccatttaaaaattcccactaataactttttggtcgcttctaactttaatttcttttttatgcctccttaaaattaaggtcattatattttggtttttagtgtaaatcatgattccttcttgaatagtcgtttttatgtcctaaagtaacgttttgttaaaaataatttttaagacatatcactttgaacctaattttataactttttacagaaacaaaagttatttttcttttaagaagtaaaaacactactttaggagtgattgaacttttatctaacatcttcgtataaaatacaggttgtttaaaataaataagctaaatttttaaggaggattctgagatgactgaaattaaagtactaaacgataaggaactaaaaaatgtcgtaggaggaaagtattacggtaacggagtgcattgtggtaaaaagacttgctatgtggactggggacaagctacagctagcattggaaaaattatagtgaacggatggacacaacacgggccttgggcacatagataacgggagacgttattatgaagaaagcagacttaattaatgcaattgatgaaacttataaagatgaagaagttaaaaaaaatcccgatataagagaatttttgttaaaatttgcacaacaattgagcgaaggacgggatgtgggtcttatatcggtaaaattaagtaatgcaattacggactattccctaaaaaatgattttattattccaaaagcattgagtgatttgtatgcgatagcggcgaaaaatgctgagaaatatcgaggaataatgtcgacaaatatttggttataaacaatttagaatatcacgtcggcagaaatttcagtgtcttttttacttatcgattaccaatcaatgtgtgaaaaaattaaactgattagtcaagttctgtaaccaacaattgtccaattattttttaagttttgaagagtttagaattgtgaagaaaatttatccgacttcattttactgataaatacagttggaattttcttgaagttatcttaatttaaatattctattttatgtcaaaacatctaaaagtgagtcttcaagatgatcaataaattcaccttgagggctcactttttaagttgctttagctggcctagaaaattatggttaagttagttatgtgcatccatacaacatttatagatctcataaataattaaatttcattatatttaattaacctaacctggtgttggtataaccaagcacggacttgtggatcagtcagcatttctacttctttagtacgaggtgtggttaaacttgagtgttttaataagtaatcatctaaatatcctgggtgacatatcatcattggatattcttcatcacaactagataatacagctcgtttcaacgtttgataaggattataatccttattcatgctttccataaaaacatgtaaactgtgtcccttgaataataaactcggtctacctgaatttaaagtaacttgcaataaatttaattgatggcatttcgcaacaactaaaagtcctttaaagaaattatcactaaccactgcatgtccttcaaaataatcaggttttcgaccaaccaattctataaatttttgatattgtgcttcaatttctaaaataacctcatctaaattaacaaagtcattgggagcttttcgataatctgcagagctaagaaaagcaccatcatcatcaacaatactcggaataaatttaggatttagtagaggtcgtcctgaacttataactacatgtagccctagacaaacttttgtatctctgatcatagacaatccgtccaaggttgtaggcatgttaaccatcacgcctacattattaattatccctttatgaacagatcgttcaatacctatattaactgcgtctgaatagcctaaatcgtctgcacgaataattagttttgtttccaccattatgcctccactaatttaatttgttcatttgattgtttattagttttagattcgataccaatactgtatgttgcaattgcagctactacaaacgcaattgttccactaattactccatttaccaagttattggtttgccctccaacatatgttgttagagacaaaaaatttgcaacaggaaccataacataagctgtaatcgcagtcataccagcatataatccaccgcaaaaaccgccaaccatcatgcctataaagggacgtttataacgtattgctaaaccgtataatccaggttcagttacgcctcctacaaagctagcaattaaataactccaagcaagtgctttttgatctttatctttaattcgtaaagccgcacctagacacattccagcaaccgacatgctggcagcaactgcaccaagggttacaaagttctcgtgtccggattgagcaaaaatcatcatcatggttgtaagcatcagcaaatgcattcccgtcataactaaaatttcccaaaaggcaccaattacaccaacagcaataatcgtcggcaaacctcctaatttcccgaatgccaagattccagcacaaatgtaattgccaacaacatttcccgctggccctaaaatacagagcataattggtaacataacagcaatcgttaaggtgggaaccataatcgtactaattgattcagcagtatgctgcttgaaaaattgttcgatataagacattacccaaacagctaaaataatgggaattactgtactagaataattaattaatggcatagtaataccaaaaatatcaaaaggcttaccagcttttacaatttggattaggttcggatcaattacaattgctcctaaaaacatcgcaataattcgagaagtattgaattgcttagacgccgtataacctatgacgattggtaaaaaataaaaaccagcgtcaccaacaaaagtaaaaagctgatacaacgtcgttttagttccgataaagttgagcatgttgggacccaaaatagcgcctaacattttaaataccgatgcagccaccatcatcggaattaatggtgtcaaacagcccgctaatttattcaaaatgttgtttgcaattgatttgaaagttaatttctctttcaagttttcatctaaaccatcttcactcgaagacgattgagttaaatcacccgtttttagtaaaaaatcatacactttattaacagtttgtccaatgataatctggtattgtcccccggttcgattaacaccgactacccctggaatactttgaatatcattatcattgggaatactttcatcttttaaattaaaccgtaaacgtgtcatacaatgggtaactgacgaaatattagcactccccccgactgctgataacaaatcttttgctacttgttcataatattgatttttatttttcatatcctagtgcctccactgaatgataattaacctttattaacaatgcgtttaacataaatcatcaataatataattcatcatcattactgacagttccaagttgatcatcaatgtagtctgcaatttgcttagctgccaggtaaattcttggttcatctagcttcatcacattaaataatttcaaattattattcttagaaatttgttggtgttcattcaagcgtttaatgtagtatcgtaaatgcataataaatctgttgtaactaaattcatttttgctaatagttatttcaaattctcgttcgataatttttgtagctatctttataatttcatcatctgctgttacctttgggttagttactaattccgttgtttcagaatttacgaaatgcatggctattgctgtgacctccgagattggtaattcaacatctaaacgcgagttaattagcttcacagcatagtaacccacagctgtttcttgaagatacaattgctctacatcatatgaaaaagggagtgccattccttggtacttagttaatcttgtgatagcaaaattaatatgatctgctaaactaaaaatcatgttcggattaagatttctcaaaataagtttttgagccttatcggtaattgcggcacttacatcaaaaatttcggtcggaatttcttttagtaattgataatactgataatttaatttataaaatgtcatactcactttgttcatatcagtcagctcatatggtacttttggaaaacccagcccttttccaaaagcaactagctgtgctccattccgatccaaacagaccaccacattattatttatttttttcaccaccagcatctcatttacacctccttacctgcttaaatattacttacgcttgtttgagaaccaatgtacccaaagcaagttgttgattaagcttgctgccaagcggtatttcacctgtatagccttccgtaaagacaaccatcgtcgtcaaatcaaaatcctctgcatccaacgttgctctgttaattgttgctatttgggctcccactttaacctcttgccccacttcaacgaatgttttaaatccttttccctttaaacgaactgtatctataccaatatggaccaatacagatattcctcgtacctcatccgtaattccaatagcatgtttactctcaggtaatgaaacaactttcccgctaataggcgcaacaaccttattcgcattattggttggtttgatagcaaatccatgacccatcattttttgtgcaaatacttcatctgaaacagctgtaattggtatgcaaacaccttcgataggggtagctacaacaaaaatattacttttcttttttgtaatgccgaacattcttaccacttccttaatacaaaaaaactccttgcgacacccattccacccgtatatttcaacaagcaaaaggtaatgcctcaaagagtatgagttacaatccttagtttcaattttaaaaagaaaacgttttcggaactatattaacacttattctattttttgcaaactatttcaaatgattggcctccagcacagaggagcagttgttaagaatcacccctgaaaagacgaatagttatccactgaaggaatcgttaaatctattaccggaattgaaaatccttaacttaaaattgactagagatattaacgaaaccaaatatcattttcacttagataatgtagttaattgtgggcgttatttcagaaacgataactgccaactagaagctctttccaccgttctattgaacttcgtataatcaccttttgagctaacaatgttaagcaagctatagaaatgcttttatttatctgaaattaccagcaatgctttaattacttgacgattactcattgcttcgtatgcatcttctatatgatctagatcaaaactctttgtaaagacttgaccagggttgatttcaccatctaaaacagcttgcaaaagaacttctttatcaggttttgtaactgaagcaatcccgccacgaagacccacgtttttccagaataattggttagatttaggttctgattgaggaacccctattcttccaattacggcgcctggacgagcaatttgacctgcttgttcgattgcactagtagcacccacacattctaaaattgcgtccgctccggcattttccttcgttaacttcaaaacatcttggatagcttcatcgccacgtgtatctacgatatcagtggcaccaaaggccttacctaactcagcacggtcttcatggtgactcaaaaggataatcttgcttgctccaagcaacttagccccgattactccacataatccaacggctccatctccgatgacagcgactgttgagcccggcttaacttcagcactttgggcagcatgatagccagttgccataacatcagaaagagtttggaatgaagctaattgcgcatcggtataatcttctggtttacccggaattttaaccaatcctgaattagctggttcatacttcatgtattcagcctggtagccaccgttatcgccggatttacgattcaaacaatctccttcaaaaccattcaaacaagctacacaatgaccacatccatgcgtaaacggcacgaccacgaagtcgccaacttgaatgttatcaatgtctgcactagtttcttccacaaccccaatggcttcatgtccgataaaagtacctgtctgacattcagaaattccacgataccaccataaatctgaaccacaaacactagcccgtacaatccgaataattgcctggttatcaccatcaatttggggtttaggtacttctttaacttcaactttacctagttcaataaatactgctgctttcatctgttaaattcctcctaaaattatttacgtaatgcttttaagctttcaccaaaaatacttacaatggcttctggatcacggtgatcaaagaactgactttcgtttttatctaaactactcatcttttgcatatcatcatcactcaattcaaaattaaaaacatctaagttttcagccatgcgtgtcttatgaactgacttggggattaccacaattccgcgttggaggagccaacgtaggatgacttgtccgttcgcttttccatatttctgaccaatttcagcaatcgtttcatttgagaaaatgttatgcttaccttccgcaaagggagcccatgcttcaacttgaacatcttgactttgagcaaaatcaactgcttcgccttcttggtaccaaggtgaaacttcgatttgattaagtgctggcttaacatctgacattaattccagattcatcaattgatctggagcaaaattagatacaccgattgacttaattttacccgccttttgagcttcaatcaaagctcgccatgcacctgctgtgtcaccataaggttggtgaagcaagtataaatcaatatagtccaatcctaatttatttagtgaatcttcaattccttgttgcgctttttcataggtgaaatgatccacccaaagcttagaagtcacaaaaatctcactgcgattaataccgctcttcttgatcgcggcacccaccgcctcttcgttgccataagcagcagccgtatcaattagacgataacctgtatcaagtgcatcactcacggcttgttcggcttggctcaaatcggaaacttggaaaacaccaaatccaagttgaggcatttggttgccatcatttaactttacatatttcataactttgtatccctttaaatttatatatcctatttatttacactatctttaagtactttctagtataggggggtaattaccatataaaaattaccaatcaagtatgttactatgcatttatggaatagtgaaaggaagtaatcgaattggcaatgaaccttgatttactaaaagagctagtagcatttcaaagatacggtacactaagctcgactgctgagcatttaatgattactcaacccaccgttactcggggaatgcgcagattagaagatgaattaggtgtatcactttttgatcgccgagttagtaaccacatcaaattaaatgaaactggtgtttacgcggctacagaagcagccaaattattgaaagcagagcgggattttaccgaacgagtattaaactaccatcacttaaatcatgaaattgtaattggttcggttgctcctggtccagttatcctactagaaaactccgaaatttcatcccctgctaaagttaaaattaattttcaaaatgtttttcctgaaaaagttgctgataatcttaaaaatcttaaagagaagctaatttttaccaaccaagaaattatgaccgatgaaatcgagtcagtttatttgggtgtggaataccttggagtagaaattggtaaatctaatccactatctaaaaaaacatccgtaaacttcgacgatttagccggaatgagtttcctcgtggtccaagatactggcccttggcaagcaatcgtagaaaataatatccctgatgctgctttcttataccaagctgacctcgatgccatgagtgaaattagtcggaattctaaatttccctattttttctccaacttatcactagttagttcggccaccattgagcgctctgatggtggcgaacgcgtagccgtacccatcgacgatcctcgtaatcatcttgaattctacggttcatatttaaaaagtaaccgtaaactcgtccaaccacttttaaaagagattaataaaatttggccgcaaaattaatggcggccaaattctcgcgatgattaaacatcaatattcattatttttaagaccgttcgcggtcttttttatttacctaatgtgattcttaaccttgtccatccttgaaagctgggtaaagcgtcattccaccatcgataaatagtgtaataccagttacataactggattcgtcagatgctaaccatgctgcacccgcagctacttcttcaggtttaccaatccggtccatgggtaccatgctgactgtttgatcatattgttccttatcagcaaatttttcggcattgatgggagtattaatcgctccgggtccaatggcatttacgcgaatattatccttggcgtattccatcgcaatcgtttgagtgaacaattttacgcttcccttagctgctgcatagctagcaaaggtaggccaaggaatttgttcatgcacggaagacatgttaataatgtttccctttttgtggttcttcttaaagtaggctaaagcagtacgtgaacctaaaaatacaccagtttggtcaattgccgttactttattccaatcttctaacgatacttcatgagttggtgatttaatttccatcccagcattattaacccagacatctaggtcaccaaatttttcaagcgccgtttcaagtaattgattaacgcctgcttccgtagcgatgttagcttgaaccgtcacggcctcgccaccagcactaattacttcgtcggcggccttttgagctccgtctggatcactattgtagttaatgaccactttcattttttcttgaccaaaacgtttagcgatggctgagccaatacctttggaaccacccgtaattacagctatttttccttgtaagtcttcatacataacgaatctctccttaagtactattttggaaatagtctcttttccttataactaagactaaaacattttttacccaaaaaagcacttaatacgccttattccacttcagatcgcccagcaaacttctctaccaaaacctgcttcaacatttcatcttcactacgatggtcatttggattaagctgccgttgattattttccgttaaaactacgattaaaaattcgattagtaaggctcttttccccgaaaaccaatcaaaagcaagcgtcccagctgctgatttaaacaataaaaaatcatttctcgaactgttaattgcagtatcacccgttctcgacactactaaccgatctaattgagggtgttgaatcacatactcgtaaacttgattgaaaaaatccatacgttcactggtatctagtaactttacgttaaagcctgcatgacttaggttgcggaaagtactttgctgaaaaaattctcggggtaaaaagaacatctgtcgaccacccaaaatgcgagattccacctttgcttgattattatggggtacatcaaccaacatttcttttttatcaccgtgaaaattaataatttgcatcccgttaatggcgtctattggtaactgcgcgcgcttttgctcttgccccgcttggttcataaagatgatttgtagcataccattatatgtttttttgcgtcaatacttacttttaagaatcaaaaccatcaacgccatatattattgggcttaacaaggtttgtaacatttttccatttgtacataaaaatatttttattgtacaaatttttcgatttttagtttctaaatttacttttggaagtttaacaaaaaaatttaatacattttctaaaatgaaattctcaataagctccgtcctaatcctatttaccctttaaaatactatttaacccccttgaatggacacaaagaaaccttcgcatccctcatttaaggagcgtatactagtttagtactacttttttttgcaaccttttcagcctgaatcacctttctaccgggctaatacaaatcatagaaagaaggaattattttgcagagtacacaagacacagattttagttacaatcccgaatcaccaatgcgggttttcaaccttcattggtacaaagaccaaatgtcgggttggatgacttctagctacattttattaacttttggagttttatttctcctagttaccggtttatatcacaaccttaatgcactaggaattacatccactattgccggcgtgatcggcttcacatgtaccctaagtatcactaatggaaaacccattaacgggattttaggttttgtgtccgcaatcatgttgatttacgttgctacaattactggtaattttagtgatgtaatcatgcaagcagcttacatcgttttattagatattcccgtggttttcaataaacactggaatagcagtgaaggcctcgttccacgcttaatgtctgggaaatatatcgtccaaacgataatcacttttttaattttctgggccttaacttacggattagacaccattattttgactagtccacgtcctattattgattcattgagtgccactttaggattaacaggagccgttttaactgttcgtcgattccgttcaacttattatttctggcttgctcaatctattatgagtattgcgctttggagtatgacagctctttctggtcatcctgtttgggtactattcttcacttactgcctctatctcttaaatgatattgtagcattggtttctagcaaatggttccatccagaccaaaataaataacaaaataaataatctaaagacctcgttagaggtctttttttgtacaaaaaaattgcaccgagaatgagaactctgggtgcaattttatattcaattaaatttcatgaatatagtttccagtgtcaacctcatcaaaactaatggtagtggctatttgatttaaacacttagctgtaatagccagtcctcgaccagtttgaatgtaaactttacgttgtttcaaatcatatcctgaccaataacgtgtataatctgacaaaatgtcttctgaagtattgcgctccatccctcgtggaattataaccggtcggaaagctgcataaagttgagcaatcccatcttcggcttcaaaatcatccattaaattagcaaccataaagcttctcactaaacgatcgggtgatgtatacgttcctggtaagccggttaagccatatcccgttccgccttcaattggatttaatgttacgccatttttataggttttaggttgtttgatattaagatcatttaaagcaatataattacgtaaattaacggtgtgccagttatattcagggctgttagtgaccactcccactgaatcataaagtttgaaggagccattatttacaggctcgagcactactccatcgccgctctcatcaacaaagctatagtgaagtgggaatgaaatcgaatgaccattgagcattgtaggttgatccactaccgcgaaattttgatagttttcacggatttctttaacgctcttaaagtgcgttaatacgtacgttacgaattctgtattcatcactggaacctgttgccgttgttggatattttccaatgtatcggcggtactctcaaataatacttgaaggtcaccggctaatccatgctcgttaatcccgtcaaataaaatgggcgttccacctataccaatccccatggcagcatagtctgcttgccaatttgcaagttggctgtcaatatcaacgccagctggaatcgttgtaatcattccacgggctcctaagtcgtgttctggatcttcgccaaacattggtaaagctaaatccatggttctcccccaaaaatgttctccatttttagccgtaatctcaatattagtacacatttaattgccttctttcaataattctaacgaaacctttataccatttttaacttaagaataaaaacattagcccctctaaataaaaaaacttagagaaagtttttaacttccactaagcttgatactttaaaataaattatcgaaagtactaaacacactaccgaagaggcctgtagcataactttcagcatttggaacaatcatgtaacgaactaaaatataaataactagtgaaatcaccaattgagcaatcactaccacatagattcgatcaattttatatttcacatttttatcaaagaaagtcgctaaaaatcctgtactaaatcctagagaagccaaggcgagtaatccaactaccaagttaaggcttccaaggtctgtacgaccttcactcaggttgttaataatcgtttgagtactaaaaatagttatcactaaagccacaaccgagaaaataagtgtgtaattaataaaatgagcaaatttgttggtatactcaatgattgaagtttcactgtcttctgtactaagaagtttttcaactgaataaccaatgacaatgtataaagcgtaaatgatagcgataactactaatagtttaaagaacattccaatggtgaagggattatccataatactttccgtattaacgccatagtgactagtagtttcgctaaacttaccaaaaatttgtcctcctggaattacgacgaataaggcaccgataatagaaaataagatgaacgttgtcattccataaaatggatgagcatcattttgagtttcaaacggtttttgaattgaagtctttacccaattccaatagttttgcgcatattgcttagtttgttgaacacgttcgtttacagcttccttgtcgacattgattttattttctggattttctgtagtggctgacgcagtatttgctgccactgcagttccacaactcgtacaaaatttatcctcagcttctagttgtgctccacaattagtacaaaatttcatttctaacatcctccaaatttattatcctaataatccgtcatacataaccgatccaaagctattcattttcttaatctgttcatcacgactgccatcttgtgacattactacgataacgaaagagcctttattattaccgaaaatagctgcatcattctcaacaccatagtcatcaaactccccagttttgttataaaccgtggcttcttccggtaaatcatgcggtaattttgtatgattattattcttctttaaaatatctagcatggcattgtcatacttggttgataccatctgatgattgtaaattttctttaagaccatccctaaatctgcaactgatgtgtagttatcttttccatctttaagggcgtctgtatccatcaacattcgttcaagcttggtatccttagcaccaattttcttaatttgagtgttaactttgttcatcccaccaagttggcgaataacgatgttagctgcagtattatcactgtcttccatcatttcttccagtagatcttgtattgaaatttctgtaccactactcatattacggatttcacccgttccgttgaccttatcggaatcttttagagtgtacttatcatttaagttcaatttaccttcattaacttgctgataggcagtgattaaaataaatagtttgatattactagctgctcgttgcgctttactgttggaaacaacttcttcagtagaatctgtcggtgaaacgtatacggaggtttcaccctgcatatctccaaaagcgtcgtcaatcgtaccttgaatggtactctttggaaaatcaatggttgattttttcgaagctttcgaaggagcggaatatgaactcgaactgctgcttttatccgctactgaactacttactggctgagttgtagattgattatttttataaataaagaatcctccaccgattaaaaccactagtatcagtggaactgcccacatccaccatttaggcccgtgtggcttttcactacgtgttccaacttcattttgaagttcagaatttgttttaacttttgtttcagcttgcggttgaacttcggaaataactggtttatcaacctttacaggttgggactggctggtgcgcaacgtcgttccacatttagaacagaacttagcaccctgcttattcttactaccacaattttgacaaaacatggctactctcccgattttttatttcgacactatacccgttaattttatcatagttatgctcgtagttatgcaatcctttcattatttttagttaactcttgctaaatctctcaaaagaagttatagtgtattagaaaactagtacacaaaggaggaaagttatgaagtttgatgataagattccaatttattaccaaataaaacaatacatctataaagaaattattattaaccacctgaccccaggatctaaagttccagcagttcggcagctagcattagacttggccgttaacgtcaacacggttcagcgctcattaagagagctaatcagtgaaggcgttttggaatcccagcgcgggaagggtaattttgtaactactaatccagagattttgaacaacttacgcaaaaatattgtcgaagaacaactttctttaatgtacgatcacctagccagcctccaactgaccccagacgagatgattcaagcattaactgaatacgtgaacaagagaaaggaaacgcatcatggctaatctactaacaattaatcatttaagctattctcgtaatctccaattaatcctaaaagacctcaatttagagcttccgtacgggcaaattgtaggcttgttgggtaccaatggtgctggtaaaacgacgttaatgcgtttgattgctggtaattatattgatcgtaaaaattctatttccattaatacagaaaccaatagcgcagttcgcaaatctttagttagttttaccgaacaagtcggtggctggtcgggccatcctcgtattttcaaaattggtaatttttatgatgctttatatgaagatttcaacctcaccactttcaaccaattactttcaaatctcaacttgagccctgaccaacgtgttaatcaactttctaaagggaatttccgcaagttagtaattgctgttacgcttgctcgtcaaactgatttgtacctattagatgaacctttcgacgggattgacagtatgactcgcaaaaaaatcatctccagtattattcaatggaagcctgaaaatgcgacggttttagtcagcgatcatcatgtcggtgatattgctaacctgctcgatcaagtcgtcattattaaggaccaacatgtggctgcacaagaagccgcagacactattcgtgaaacccttggtaaagatattgaaacttactacgaagatttttatagagaggagctttaagatgaccactttctcacaattaacgaaaacaatgttgaaaacccgagtaaatcttattcataaggtctttggcatctatctactagttaccctagtcacttgtttctaccaaaccttaattcatggacttagaataaccgactggttaatgtttagctttagtttcggtgtattggcctcattggtactggccgttattctagcagttaaacaagaacgggtttggacggctcccctctaccgacttttaccgctttcggaaactaagctatatatcggtaatgtacttacaaacttttttagttggatttactttgaaattctggtagttctactaacgttcattatgggtcctactagttttgtcaaaattcttcaaaccatgaataatggtagctttttagaatatgcagtaggggccggaatcattttgatttttccaaccttcatttggtgctcagtcagtttagttcacttactaacgaatacctttagtgattttctaccaataaatattcaacgcatttctcgagtcgttttaatcattgttcttgtatacggattaggtaaaataagtaatttagcaacaaactcctttaccatgatttttgcttcatctcaagctacgtcggatgctagcttctatctatcgtttatttatctaatccttactactatcgttgtttcaattattaatatctacctacttaaaaactgggttcaagctactcccaaaacagcataaataaaaaaatagtctaagaatgatcccttttaggaccaaccttagattatttttttagattaaattgatattactcttacatttttccaccaaagactggaaagacacttgcatccccgtaatctagtggtttgacttgtttcaaaatttccatatcttcatcagaaattacaaaatcaagctcggcgtttgatttcatgtgttccggattagaagttttaggaagtactaccgtatctaattgccaatcgtaacggattgataattgtggtgcactaacgttatattttgccgccattttttgaatagcttcgctacgaagtgcttgtccatgagcgattggtgaaaatgcttcaaccacaatcccattttcatgagagtagttaatcaaatccattggtgtagcagctatatgcgataagatttggttaaccattggcttagtatcactatttttgattaaattatccaagtcttcgttttggaagctagaaacaccgattgcacgaagcttaccttcatgcatagcatcttcaagagcacgccaaacttcaaggttaccctcaaaatgacgttcatcggattgatttacttctgcccagggctgggggttatgaataatcatcatatccaaataatctagacccattttgtttaaagtttcatcaatagactttttggcatcatcataatttttaatttcagcagcaatttttgagttaacaaaaatttcttcacgaggaacacttgcagtacgtacgccttcacctacgccacgttcattagcataagcttgggcggtatcgatatgacgatagcccatttcaattgcgctgcgcacagcgtcagcaacttgatcatcagcaatttcccatgttcctaaagctaacttagggatttttacaccattacttaatttgtacgattcttcaaaaacattcatattatcatttctcctttaattaaacggtttgacctgtaggacgaattaccatttcattaacagccatattagctggggtgtcaatcacaaaggccactgcttgagcaatttcttctggattaagtcccgtcatttcagctcccggtaatttttgagcatccttcaattcattacgaattttttcactattgattgagttaaatagctcagttttcacggtacctggagcaataaccgtagttttaatattattttggtgttcttcttggcgaagaccttccataatcgcgcggaccgcatacttagtacctgaataagccgcataacccggtaaaacttcatagcctaataccgaagaagttgtaatgatatggccactttgttgttttcgcatgatgggtagagctgatccaatcccatttagcacacctttaacattaatatctaacatttgttgccattcattttgagcaacttgatttaaattattaactggcataattccagcattgttaaataacacatcaatccgaccaaatttagcaaccgtaccatcaattacagcttgaacttcatcttcattggttacatcggctttgaaaatttcgatttcagcctcaggatattgagcttggatttcttgtaatcgatccagacgacgagcggccaagctaagcttagctccttgttgcgctagcattgctgctgtcgcagctccgattccactcgaagcgcccatgatgattactactttattcttattactcattatttttgatcctccttagtattcttgattactttaattacgcgtgctggaataccagcaactatcgcattgggtggaacatcgcgggtaaccacggcgcccgcagcaactactgcattttcaccaataattacgccaggagttaccgttacattggcgcctaaccaagcattattatgaatacaaaccgagtctaaatctagattacggcgctcgctaggttctagacggtgattaacggaagcaatcgttacgtttggaccaatcaagacgtgatcaccaatatagataccacctaagtccacaaacatcgatccgctattaatgaaaacttttttaccaatgtggagattgcgaccaaaatcggtttgaaaaggtaatcgaatttcagtcgaaccatcaattcgctcgttagtgatttggcttacaatgctaagtacttcatttgccgaatgaatcccagtatttaattgctgaaccaaccgttggtttttagctacgatttcttcgacaccatcataggccgctgttcccaaatccattttggattgcattaactcaccccgcttcctaaccttattgattgactctagtctacgggatcgttactataatgttaaatacttattaaacatcaaaaacaataacttttagttatgaattaaaggaaaatattatggatattcgtgtcttacgctattttgtggtaattgctcaggaacaaaacatttcacgagcggccactttacttaacgtgtcccagccggctttatcacgccaaattgctgatttagaagatgaattagggactaaattatttactcgtgcccatcgccatattcaacttacgcaggaaggtcattacctactagaacgggcgctacaaattattggtttagttgataaaactacttataacttacaaaaacaagatgtagttagtggaacgctcgacattggagcaggagaaagtgtggggattatgccagtcatggaggcagcccagcaaatcatgcgtcaataccccgacgttcgtgttaatcttcggagtgcggatgcggaacccatcttagctgacctcgatgcaggcattttagaatttggcattattatgggaaatcgcccccttaataattacaacactttggttttaccagctaaaaatcattggtgcgccatcatgcgagcagatgaaccgctcgcccaacagaaagaaatccgaccaattgatctagtcggtcgtcctttaattacttcacgtcaggcttacaaacacggtttattccaaaaatggagtaacaccctttatgatcaacttaattttgtgggaactttcaatttggcttttaatggtagtttactagtcaaaacgggagcagcaattgcacttttatatgatcaacttgtggatgtttcaccagcaagcggtttggttgcccgcccgcttaatcctgacatgtcagaagcgaacacactcatttggagtaaaaatcgaaatttacccaatttaaatcgattatttttagatactttacaaaaaaatttagctcaacaaggaggctctgatgcctaaatataccgttatttataatgaagatgctggaaaaaatgataataaatccatcgctgaacgttttcagcaagcggctgaacgcttgaagcgatcaaccaccttaaaggccacgtctagtcgtcaagaagcgctcgattacgtagtcgatcatattgatcaactggatacagttattacaattggcggagacggctccattaataccgtgttttcggcctttcttaaagctaaaaaatcagtcaaagtgggaattattcctgggggtaccgtcaataattttgctaaagcactcgaaattcctcaagatgaagaagccgcttttgataccattcttaatggtcatcccctcgctgtggatttggcccatactgaagaccgtgccatcattagtagccttacacttggaacccttgctgatatggcccgccatgtcggacaagatgaaaagaaaaatggggacctttaatttatttgagtaaaggaattcgccagttaattgctaagaaatcttaccagattaaagttaggactgcggatggcgaccatgtctatcgcacgcgcttcctattagcaaccactaccaactcagtgggtggttttactaattttgatacatctgcatctccagcagatggtaaaattcacttggttatcctgaaacatttttcattcatgcgtcttttaggctacctaagttatttcctaactggacgttttcgagatatcaaagatgttgatcaacttaccgctcaggaagttgaaatttctgccgctgattcacacttgaaggttgaaactcgaattgatggtgatcctagtgaccaactccccatcaaactgggcgtagagcaaggcttcgttcaagttatggtacctaaataatttaactcaaaataaaatggaccaacgcaatcaaagcgttgatccattttttatattatcgaaccacagttaccgtgatgggagcatacttcgccatgtaggctgcttggctaccaaaatgtcgtgctaacccttttttagactctgcgccaaccactaacaaatcgggttggacagctggaataacttcttccacaatggtctcgcccggatcgccttccgtaacgacgcactttacattttggactcccgcatcctgagcctttttctgatattttaagatatgttgttcaagttcggcccgttctccatgaataaagtccttatctagcgcttgaaaaacattcatttcgtcactttccaaaactgatacgattaccaattcagaacccgattttttagccagattaattgcataatcaaaggctaaaacggcatcttccgaatcatctacaccaactaatattctcttaacatcaaaggtcattatgcttcctccttagcttctgctttactttgcatttccaattcgtaacgttggttacctttatggagttcaaagactgtccaagctaggagtgctagaactactgccactagcatataggcaattatgtgcgccagctctacttcaccagcacttggattagctccaaagaaggccgtaattgaatttggtaaaccagtcatattgaggtaggttaggaaaataaccgaaatccaacctaaaattttgaccgcccaactattcttaaatcgatcacccatttcaacgcgactatcagtcatcatcaacaatggaatcattgagaatggtaatgcaaaagccaaaaatacttgagagttattcatcaactgatttagggcttcgtgttcttgaagatcacctttaccgctggtaatcatgacacaaatcaaaactggtacaactgaaatcaaacgggtaatcaaacgccgtgcccaaagtggcattcgcatgtgaatgaatccttccatgataacctggccggttaacgttcccgtgatggttgaattttgaccagaagccaacaaagctaccgcaaataatgtcgaaagtaccccagttttggcaactccaatcaaaattccgttactcaaagttgaagtatcattcaacgcatggaatagaccaaagaatgatggatcttggacagcgccggacttaaatacggcaactcccatcaccaatagaagtgaattaacgataaatgcgaatgatagctgaatatttgaatcccaagttgagaaacgtagcgttcttgctacgtcttcttcatcgttatgatcaatttcacgcgtttgtgaaaccgctgagtgcaagtacaagttatgaggcataactgtcgcaccaataattcctagtgacccacttaaaggagtcattccgccaattgttggtgaagtttcaaatgctttagtagttggtactaagccgctaaataccgcaccccaatttggatttgataaagcaacttggtagacgaaaaccactaaaataaccatgattaaacacaccacaatggcttcaatttttctaaaaccaatcttagtcaataacagtaatagcagtacatccaaaacggtaatgaaaaccgcaatggctagcggaatatggaacaacaaatacagcgcaattgcagcaccaattacttcagcgatatcagtcgccataattgccaattccgttaaaatccataatacaattcccaatgacttacttgttctagcgcgaattgcctgcgctaagtccatttgactcacaattcccagtttagccgccatatattgtaacaacatcgcgattaaactcgaaatcgagataatcgacattagcatgtactggaagttttgacccccagtgattgatgttgaccaattaccagggtccatataaccaacagcaactaatgctcccggacccgaatacataaacagtgccttccaaaaaccaatattcttaggcaccttaactgtcccatttatttcttccaatgatcgtccattagcgtattccactaatttgcgacgtttctttgggttcttgatctcattactcatcaaaatcattcctttcctcaatcttgaaccacggctatcgtaacatattgttcacgatgcgcaaactctttttgttgccgttagacaggcatttgtggcttcaatgattaagaaaagcttgatagatgaagctcgaaaacgatttcttaaaaattttaaaataattttccaatgtagtaatggataaacattgtgataattcccacaatcacgtttcgaataatagctttttttgccatcccatttcccaatttggcgctcaaaaaaccagttagcgctacggaaaagacggtcgctataatcgtcgcttgcattttaaaagaagttggtgccatcgacatcgctactaacgggaagaagccccctaaagctgctgaaatcaatgatgaaacagctgcactccaaggattcaagtaatcttcaatatccatatcgtagcgtacactaaccgcggtttttagtggtttttcttgcatcaaagcttgtgaaatttcatgagctgtttgttcactaacacccttatcgacataaaaacgtgcgattaattcttgttcagcttggggatcagtttgcaaacgtaatttttcttcacccactaccgctttttcagtatcacgttgtgaactaactgaagcatattcgccggctgacatggaaaaagcacaggacaaaagatccgataatccagcaatgaaaataataaatggattagtcgttgctgcaattacactaaaaagaacaccgaccaccgttagaattccatcattagcacctagcactccggcccgtagcatgtttaatttattgtctaaactgatttcttttttcttcttcatgcttattttcccccttatctagcaaatagcgaaccgattaagtatgtcatcgccattgtaattaaacctgccaagacgtttcgtaaaaccgctcgtctacgaaccgctttaccaatgactgccgctgcataaccagtaactgccaaggcaatcgcaaccgaaacaacggttaaaggcacacgaatactatgtttagcgaaagtgatggtgaacaagggcaacaaggatcccaatgaaaatgaaatcatggaggaaatggccgccatataaggactggtaaagttattcatatcaaaaccatatcgctcacggaccgtagtcaaaagagcatccttttccatcatttcggacgcagccttctgggctaggtctgttggaatcccgtcattcgcatatttttcagcaacaaaatccaattctttttgatagtcatcttttaaagcttgacgctgaacattgaccgcattttcttgggaatctttttgggagttaaccgatacatattcgcccatggccatcgaaaccgttccagctaacatccccgaaattccagatataaatatggcaaaactattagtggtggctcctgctacacctaaaacaattcctgcaacagataaaataccgtcatttgcgcccattacgctagctcggatgatattgattttttgtgcgagtgttccagctttttgtttcttatccatcttactatccccttgttctaatttagaatcattttaaactgacaactaattctacttcttttcatccggaattgtaaagttcttttaaatcttttataaatcccgtttaaactggctatatttaggttaaattgaagttaaatgaagtacaacaatcttgaaaacaagtgatttttcatctatagtgtttagatacttaggattctctcgtccattgatatacgggagaatctgttcacagactcaactactaattaagtaaaggagctcttaatgctactatctttaataataattttaattttaattatggcgattgctcgcggctggcgccgagggctcatcctggaattattgtattcactgggttatatcgttgtttttatttttgctaaagtttttaccaatgactttgctgctttcctaactactactttcggaggctggactagtaaccaagttactaatttaacagtcattcattccgtcgcctttattctactaatgtccatcggctggatcattattcgtttagtagggcgtttatcgcaaatggttacttggctaccagttatccatcaagtaaatagtctagctggtgcggtggttggtttagtaattacttatggaatttcctttgtcattctcagcatcagccaatttattcccaatgatttttatcaagagcagctctcccaatcagtagtagctcagaccattttgtcgaaaactcccgctgtttcatcagaactgatcaataactacattattcataccgaacaaactaaaaacgtactataatcaggaggaactatggaacttcaattaatcaagaaatatatcgcagcctacctatcaaccacaacaacccgtttagagactgtggaagcaccaatgcccggaattaaagttgatattaatggtaatgaaagtttcttttatcccagtgccaacgacgaaaacaccttctttgaagaatatggtgatcatatctatgttcatgtttacaatactgagactaaagcttttaccacaactgaaaaataactgttaggagttgcgacaaagacgtttaatctaagttttaaccttgatccgatttagattagactttgttgtagctccttttattttggacaaattcacacaaaaaattacttaggggagaatcatgtcgagcactctgaaaacttatcgttatatttttaaacacatttttagctatatttggctttttattgcttctacagttgctgtatacggaattttaatcccaatttttacactaattggaagcataatgctacgtttggcaagagttcgttacatctctaataccaatttaattgaaattattagccagcatcctgttttagatttaggtttaattcttttaattctagcagtaattgtggccatctattggcaagtcacatttctatttttaggaaccatgcaaattaattatggaaagaagttaacgattgattcactcttacggctttccgttcaacgtgtccgtaagaccttttttcgttccgtttggttcttactaatctactgcattttaatcttaccttttggtggattaggtttttcgacacctttattaaataaaattaggattcctagtttcctagttgattattttttaactgaaaatcgtccacttttgttagtgatgattttgctatacgtggttactttttacctcggaattcgcttattcctagttctaccattaattattttgggtaaacggaacgcccatactgcggtaaaacagagttggcaaataactaagattaactttaagccaattgttttacgacttgtattactctttgctaccaccattgttgtaataattgctgggcaacttttagtactaggggaacaaacccttttcgaccgtatgacaccaaccggagtggcctttctcgccgcttccgtaaacttaattttgattgaattttttatgtttctttcgagcattgccgcgggtgctggttctttgatgatcatgactgaatacctggctggagatcagcgctttactgcccatactcatcgattaagcgaccagcttcaagaacttagctacaacgtcgggaaccaacgttggattcgaattattgctggtttacttgttatcgggggcattggatttaattcgttgtatctaactggattttttagtgacactcccattaccatttctcatcgcggggttaacgctaaaaatggggtgcaaaataccattgagtcccttaagaatactagtcgattacatcctgatttcatcgaaatcgatatccatgaaactaaggaccatcaatttgtattaatgcatgatgaaaatcttaaaaatttaaccggggttgataaagcaccgcatcaactgactttaaagcaactcaccaaattaactgcgcatgaaaatggaagttcagctaagatagctagcttagatgattacatggacgctgctgaaaagcttaaacaacccctactaattgaatttaaaactactaaatacgatgatccaaaagtggttgagcgtttcaatgctaaatacggacaaagaattctaaaaaatcatgatcaagtccatagcctagattatgatgccgttgaaaaacttaaagaacttaatccaaaattaaccgtgggctatattctgcctttcaattttattggagttccacagtctagcgccgatttttacacgatggaatattcaactttaaataactcatttttactaactgccgaactaactggtcgaaaagtttatgcttggaccgtcaatagtgacgatgcaatggccagattgaactttatgggagtcgatggcattatcaccgataaacttgaacttctacaaaaaacggttaaacaacttaaccaccatccaagttatggcagtcgattaatcaactttacttatgaacttggcagttaaaatattcaaaaaggcgaccataacattaatgtcatggtcgccttttttcgctgtattttatttcatactctaaatattttttacatactctgcatgcttcgcttcatcgaactcgccttccgacttgcccatgataattgcagctagtgagttacccaccacgttaaccgcagttcgacccatatcaataatgcggtcaacaccagcaataaacgttaaaccagccatcggaacaccaatggtagaaacagtagctaagagaaccacaaatgaagcaccaggaacaccagccatccctttagaagtaatcatcaatactactagcagtgtaatttgttgtccaatacttaaattaatatgataagcctgggctaagaagagtgccccaactgcttgatagatagctgatccgtccaggttgaacgtgtatccagttggaataacgaaggatacgattccttggctaacaccatatttttgcattttatcaataattttaggaagtgcagcctctgaactggctgttgaaaatgctaaaatcaattcatttttgattacctttagcaactggaagaatttcacgtggtgaatcttagccacaattcctagtaccacaattacaaagaatgccatcgccacgtaggcaatcaagatgaacaatcctaatggttttaaagcgtcaatccccatttgagcgattgttaccccaattagagcgcaaaccccaataggagaaaggtgcataatccagttagtaatcttaaacattacttcttggatagcagtaaggccatcaatcaagatttgtccttgtttaccaattgccgtaattcctaatccaaaaagaactgaaaatagaatgatgggcatcatgtttccttcagataacgaactaaagatattagttggaataatgttcataatcgttgaccataggccactgctttctttagcgtgttttgcagtttccacgtatgaactaatatccgtactttgcaaactatggatatcaatataagttcctggatgaaaaacgttagcaaaaatcattccgactactaaagcaatggtggttagaatttcaaaataaatcaaagttttcaatccaacacgacccaattctccaatgtcacccattcccgcaatccctacggttaagcaggatataacgattggaagaacaatcatttgaatcaagtggataaacatggttccaatattttgcatcgccgtaatggcaacttggttatggtagaaaacggcacctaaaaccactcctaggatcaatcctatcaggatttgccaccccagcgtcaatctccaattccgaacttttttcatattcacacccctaaaatttatgctatttactatactatcatatttttaattaaaaattaatcataggttaattccaaaaatcttttgagaaataacgaatacgttttcatctataaaaagtaatgacaactcttttcatttacgttaaaatagcatttctgataaaaaaataaatggagaataattatgacaacatcttacttgcgcaaagcaactaaggctgacttgccagccattttagaaataattgatgcagccaaagcttaccttaaggaacaaggaattaatcagtggcaagctggctaccctactaaccaagatattgaaaaagatattgaacaaaaaattagctatgttttaatggtcgacggtgaaattgcggccactgctgctttatggcctgatcgagacgtaaattacgatgacatgttggaaggaagttggagaggtaatccggaagatacttacatgtctattcatcgaattgcgatgtcttctaaattccgcggtcaacgactctctgaaaaaatgatgtccggacttttcacaattagttccgaactaggctacaatgaactccgtattgatacccaccccaaaaataaaggtatgcaaaaagttattgctaataatggtttcgaatatcgtggcattatcgacttcaatgacgaaaatgaagttgatacaacccgttttgcttatcaattatatctaaattaattagtatattttaaaagagatttcagtcgataatattatatgtacgaaggcatttcatttacacaagattcttgacgctaccttttttctcaattttacactaaaatagattttttggaaaactttgcaacagaacccacaaaactatacacaaaaagcagccaaatttataaaaaattcagctgcttaatgtcaagctattcaattaaataattctgctatcagtaccatttgacgaacagccaaacttcactccaatttttggagttcagttcaatcatcagattcacaagctttatattattcaatttcattatttttcatattgttcgatgacataaaacctttaaaattaaatgctttcaaacgcacaattgaatagataaagaaaacaatatacataatcaaacaataataccattctatattaaaaaaagctttagttatacatactatcaataacactattaatattaaaatatgacttatgattttgattttaaatccattttttgcagaaaagattgtccttaatacaaagaaaacaatatacgataatgcatttgccaacgctgcaccccgactaccaaatttcggtattaataaaaatgacaacccgatattagcaagcaatgtaattcctgatatatagatatttaggtaagtttttctcgaaaaaacgattccaatattggtagtttcactaatacaactaagatatactggaatgatcattagtggaaaataatattgaacatctctatacttattcgacacaaaaagcacaataattggtccaataactgtcattaagaaaactatattagataaaatgagattaacaaattcactaaccttttggaatacaattatgtctttatactcattcatccatctgtatgatacagggacccaataattaacaaatatagtttgaataattgtcataattgccattacttttaatccaactgaataaacacctaactcttgataagtactatatatatttaaaaaaattctatctgacatttgtagaaaatttgttaacgaaactgatataacaattgggaaaccaaatataaacatccgattaatcaattttaaatcaatccattggttaatcttaaaattaaataatcgcctatacttaaagattaaaatgcagtcagccgaaatttgtccaataattgttgaccaaacaacaacggtaaacgatctatttccaaaatatagtaaaatacatgtagcaatcaacatacataattttattgatgttgtaaagaaagaaaatgctttaccattctccgacatacgcaagtacattaaaataaatctttcaaaaattgtaaacataactagcacttcaaatgctattactagaagaacataattcttactaggataaattaaattagaaatttgatgcaaataaaataacgaaattaatagtaaaacattgaaaaacatcaatggaactattatgcaattcatgaaaagtttactcttatcatcttgttcgttatattccctggtaaatgcctgatcaaatccaaaatacgcaaaagaagcaactagaccctgcaatatagtaaacatacttgctttaccatattctaccggcgacaaaaaatatgttgtcaatggaataattaaagctgttaatgctcctcctaagattggccccatcgcaaagcttataaaattaactattttgtttttcataataaagtattttccattcgggaatttttacagttcacaagtcgatggttgattaaacttttttgataaagcatctatcattttatctggcaaatctaaagaatcatccttgatggatgcatcgttaatacatatgtccaaatattttttattatataatgcatctttaaaagaattatcatccattaatcctaattcaaaatatttatgctttcgaggattacttgcttggaatttagaactaactaattgatagtatcttattaaccaatccgttacgtcaagtctattcctagttggatggcttgctgcctgatgcaactcatcatagaatagacgccaacattcctcaaaacttgtttttaaatatggctgtgcactgtgcgcactataaaatcctaaataaggtctaaacacagataaaaataatgaaattgtattattaattaagccatatttaaaattaaatttttttgtcaaattttttgttaaattatcacgttttgaaaaagcctgattaatcgcatacaaagaattaaaaatataataatcatttagaaatagtggataagttggccgttcaatataaaaatcatttggcaacccgtctctaaaataatcacttacctttgtggaattaacaacaaacatatcatcatctaaaactataaatttttcactaatttcaggaattaaatgcataaacatcgttatgacgatagaactaaacgttggtaaaaattcatgaggtataaattcatcatgattaataattttaatttttggtgactccacaaaccaacttggcttttgaccggctgttaccaaaaaaatttgatgaacccacggcatattatattcaactgatctaatagcatacttaatagtatcataatctctaaaacgttcaccatccaaatcagtcaaatcaatatactgtttagccttatcgcgccaaattggatcagtattatccacccatggaataacaacatcaatatcttcgtctaacatttacaacacttcctttaattttagaagaaatccatacatataataactcatcataattaatagattaatttcctttttgtttctaataatattattttttaaaggagatttctttataaatgcagaaattctccctaccaagacactcttttttatgcgataaaataacggcgtgttttcttgtgctaagtataacatctgctcatagatagccccatttgggttctctatttccaattttctgatactgtttgttaatccatttggctgataagcccctacacgaatgattttctttataaatttggatctaaaaactttactaaactcgacgtacaaaggaccctcactaataaatttttcatttttaaattctggtagcctaaatttctgtaaacactttgttacaaaaacatccgtaaaatctccagaaatatgatgatttagtaagtaccaataccgcctaccaaaatctattttgtttggtaatggttgtactggtacgttctgcatcttcccatgttcatatataagtgacccaatgttctcttgtttagcaacttcgtagtcttttaaaattgtttctattgcatcgtcaactaacacatcatcatcatccactataactgttaaatctgttactatttttggaataatagcattcaacgccctatgttttccaccattttttaaaactgtatattttatttcaaaatcattattattcgaaattagttgatttacagtcggcgacacagcaacagtacttccatcatccacgatccaccaaaccattctcttatcagtttgctgacataaagatttatataatttttttaggctttctggacggttgtacgtactagttaaaatagttatacgtgcatttttatctatcattatattcctcaactctcttgtttgataacatataagcaaaaattatagtcaaaataaatgtggatacagccgcattaggaataaaaagaatattttccataactagataaactgaatagaatacaaaaagtgtaagtactatcgagctctgtttttttactatcatacaatataaatacaatacataaattaagagaaaactaaatcctacaatacctattgttaataaaaagtaagctaaagaactatcaattgcgaaacgttctccagttaatttttgttgaataaagctcgtactcattgaccctatacccaaccatttatgtaagtcacttcctgctaaactcaatgccatttgactatagtttaaccgataacttaaaaactcatctaattgcataaaatgagtattcaaagaatttgaaaaataaacaaaatataaaaatactgcccaaatagttgttaaaaaaaagcctgttatagtactaacaataaactttattttttttgatcctaaactgtgaactaaatagaccactagtgagatacctaccgctaatacgggtgttcgactaccagaatttaaaattataaaaatactaaataacactattaatatattctttaaattacttctatttttatgagtaataacagcaattagaaccaaaaagcctgcaaacatacccaaagtattcacattattgaatcccatagatatacgttgtgtaagaatattattaccatatctttgattatataacatactattaattaactctaaaacgttataagaaacgcctttaaagataaacatcatcaaaaaaagcataatagttagagtccaaaatatagtagtgactaaactcatcgggttatctcgaaatgcatttatagaacaaatcaaaaacaacgagtaaaatgcatagtaaacgctatataatatcacttgtttagagaattctccatatacacccacacttgtcattaaaataggatatatacaaaaaatacctaccaatggcaatataatagtgtaatttttaaaattaacattccaaatattacaaataattattaaaaattctgaaacaagtcttaagccggagccaattccactccattgtgtatagctcagcacagatcctattacaaacaacattactaacaagatatttattacattatttttttgatacattttttacctcaattgtcaagttaagtgcaacactaatggcctattcttataattggtctagaaagttaaaccagttgtggcataacatccgctggacaactatagcttaaacagcgacggggacggtgattcagcgtgtcttgaaccaactgcagatccactaatgagaggtttttaaaggaatgccctttgggaagaactctcttaattgaccattcacattctcattagtgccccgttcccagggagaatatggatgggcaaagtagatttccgttccttgaacctgatttaaactagcgaattccgagccgttgtcaaacgtgatcgtccgaaagttttctgcaccgtaatcatcaatcgtatcttggagggattgccggcaagtctctgcccggtaatcaggcaatttaacgataatttccatccggctaactcgctcggttaacgtcattaaagctggttcggactcaacccgtttggctttcactaagtcgccttcccaatggcccaactcctgacgtttccgaaccactgcgggccggtcttcaatggactgtccaagccgttttttattcaggcgggcatgtcggtgattcgggcgtttaacgcggcgacgtagcttcatgggtaaatcatagttgtgaagctccgggagcttgccagcctcgatataccgatagaccgtagccgttgatgggcagggaaagcccgggtaatgagctttgaaatagtggacatacgtatcgacactgaaaactcgtggcttagcttttaaagctttcggcagggacttgaagaacacggcagcccgctgcagtaaacctttggggtgacacttggcccgctgttctcgatagtaagccgccccgcgctcggcaaagtagccctgatatgaccgatgtttctgggaatcaatctgggtggttaacccgcgttttaattcgcgagaaatggtgctgggactccggtgaagccggctggcgatctgacgaacgccaaatcctaatcgagtcagggactcaatttgaccgcgttcaaaagattggagttgttggtaatgcttaggcatgatattcttagtttgggtcatgaagacacctatccttatctgttgattttgtcgttaataataagaataggccttcatggccttttaagctagtctaattggtctagttatcaagtgttgcacttcaattttaaatcggggtttttttaaaaagatcagtaactttttcattctttattattatcctcgttgtaaaataagcaacctgcactcatccacgcagaactttcttataaacaactttgcgtacagcttcagggcataacccaaccactgtacctcccgcaattgaaacgattaagtcttttaaagaaatcaatccttcatcaaaaaaaagacttctcgcacgaatattttgtagtacatacttgaatccaccacgtcgactttgtaaacctgaaactcttgccgccacaagtacttgtggtaagttactaatcgccattgcatctctgttcagcactcgaagccataattcataatcttcataaccaggcacatcgtgatacccatgcatgacgttattaataaaatctcgcttaaacatgactgtcatatgattcaaaggattccgtttacgtgaaaactcaaatattttacttgcttcaattgggaccttccggtaactaactggagtttcccatgtttcaacatactcctggattgttcctcccaataccatagattctggatgtctagcaaaaaaattctcttgcaaagcaatacgatcaggtagagcatgatcgtcactatccattcttgcaataagtgggtacttacattgagccaatccatagttgagtgcgactcccagattttttctatgcttcactcttactaacgtaatttccaataaagtcctgtatttctcgaagaaccgtttcaatacttcttccaaggtatttggtaagtatccatcacacacaataacaaattgccggggcactttggtctgttgaataatactttccattgcctcactaagaaattgaggattctctttaaagtaaacagacatcaaaaccgaaacatttgcatacttcaacgtgcaccatccccagtaaatacaattttaacagtaccaaacaacattttaatatcgaaccaaactgaaaaatgttcaatataataattgtccaatttacatttagcatctggcgtaatatcatagccaccgttaatctgcgcatatcccgtgattccaggaattattcgtaaccgtttagggaaatctgggaactgctgactaaactcttccgtcaacacagggcgttcgggacgcggtcctactaaactcatatcacctttcaatacgttccaaaattgtggtaattcatccacccgagtctttcgcataaaccgaccgacgggggtgattcgtggatcatttttttgcgcccatactgcacctgttcgtgcttcagcatcttggtacatagagcgtaatttaatcacattaaagctctttcccatcagcccaactcgttcttgcttataaaaggctgggcccttagatgtcagcttcacaaaaatagcaaacaccaaaacaatcggtgaactcaagactgtaccaattaacccaacaatcaaatcaaaaactcgtttcacaaccaatttccaaccggaaactggttttccaatcatcattggaaagtggtagtttgtctggggttgaacacgaccaactttgactgtttcattaatttcgacttgcttcacgtcgttgcgccccttcccaatatttgctcaagcccgcttctaacgaccacttcgtcgtgtaccctaacttaattaacttacctatgttggccactgaacgttttacttccccttcacgccctggcgcctttttaatctgcaatgacgttcctgcaaccttctcatatgtttcaataatggcatttaagctggcttcattaccattggcgatattaaagacttcatgctcagtatcacttttcgttatcagccataatgcttggataacatcttcaacatacacaaaatctcgtgtctgactcccatctccgtacaatgtaaatggcttcttattattgagacaatcggtcaaaatcgacagtacccctgaatatggcgaactggggttttgaccgggaccataaacgttgaagaagcgcacacagacagttggtaaatcataaagttcaccatatgctagtacaaagcgttccgtagcatacttatcaatcgcatatggtgataatggatcgactcgtgagtcttctttcttaggtaattctggaagattaccgtaaaccgctgccgaagacgtaaataggaactgtttaattggtaaattggttctccgaatatattccaacatattgaatactgcagtttgattcactgaatgggtttcagctggacgttcaatcgaatcggcaacactagcaacagctgctaaaaagtaaatataatcaggctgttcttcctgtagcaattgttgcatgaatttttcgttgcggacatcttcgacataaatggtgacttcatcctgatacttaatattatgtaagtcccccatggacaagttatcaactacgacaacgtccaaaccttctgagaccaagtgatccacaaggtgggaaccaataaatcccgctcctccagttactaatactttcatttaactcgctccttcttttaaaataaccagtgctttcgctgttttcgtggtatcccaatcttaccaccgtaaaactgacaattatacgccagtacttacggacaagccggaaaaaaagtaaaaacttactgtttgatccatcattcactctccaaaattaacaagattaaaacacgttttaactaacactattaaatacaatctatcatagaagtgattaagatgacaatagcaattaaagaaagtttcccctacagatatgatgaagtaggtagtttattacgtccggaaaaattaaaacaggcccgttggatgtaagatgattcctgagacaacttttaagagagggtatggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaacctttcgtgaactagggctgtccaatatccaaacgggcgttcagctgaaccgatcaccgtcaacaatttcttacgaattatcttgatgtcaaccttatcaggctgaattagcacaaacagatgccgaatacaagcgatcacgatgtggtcggaaaactaagctgagcgatgagttaaagcaaaaaattctcaactatttacgtctaagctggtcaccaggaatgattgcttgggcttcttcatcatcaagcgttttgccggcggtcttcatggccgtaatcagggtaccttcgttaaagagtaccggtggtgtcgtttctttttgcggtgtttgcagatttgctttaacctgatcgcctcggtgaacgagcgggaggttggctgccacttgctggtcggctttgtgatcatcaaataaagcttgccaaccttgcttagttgggaccttacccgtcgctttaaaattgacgtcgccaacttgggtgataatggtggtctcttcatattcgtaaggatcagcaaacatcactaacgtcgttcttaaaaccaagtcatagacttgctgctgtattttaggtaagctggctaatttctctttagtcgggacgactttggtcatgataatggcgtagtgttcttcaaccttttttccattaacatagcgcttatttggggtggtattggttcaagcgactggcttagagactaaacccagatacttcgtcagattagccactaaatactcaaattcttcatcagtgatataagcacaatcggttcggggatagctaagaaacttggcttcgtataaactctgaatggccgctaaggtttggctggcagtgacatgataccgtttatttatggcgctttgcagactggatagcgagaatagttgtggactagcactctttttagcccgtttttgcacgtccttgattaaaccaccctgtgagcctttctgaacgtgtttagcttgcatgaatgtcattagccctatttcgtttttaaaccgctgataggggtctaattttgcggcgaatttttgatgattggctaaaatttccgcatttagttcaaaatagggttccggcttaaagtttttgattgcctggtctctttgatagaccatatacaaggttggcgtctgcacgcgaccaattgaatacaccccgtgcaccccattttgtctcaacaataaagtatataagggactaccattcataccgatcaaccaatcactaattttgtgattacaagtgcatgcccccatcttcatgccgatttcgagtttggtgttgccgttgctttttcgtcatttcccactcagtctcctttaaaccttgtgcctgtctttgtcgttggtaatcttcatcacgagcatatagaacagtcatgatcgcgtcactaaaggccgtctttaagtaatagtctggactaactggcttgtaatttagcggttgataatgtccgatattttcttttctatactggtcgtccttggcttgttgcccttttaactgtttttggattttctcgatctgactgttcttaatcgtcggatcggctttgcattcgccaaaaaagagttgtttagtgccatcatgctttaaaacccgttgtaagtgatgattttctaactgatctaagctaagctgtcccgataaataagctagtccttgttgatgttcttggggactgaacacctgtggtggatttgcttgccactgttcaatcgtttcggcctgacatggctttaaaacaggatcatagtacatcacggctgtataggcttgttcctgtttaatcaatggcaatccatctaaatcacctttgggaaaggcccttttcaatacttcatggtattgcgttttaatgacttgcttaacggccatgattgcccgtagatctttgactgcgtgagtaatcttttgctgttcggttggtgaatatttctctagtaacccttgatcgacgtgttctagactttctaagttatcgtcatgaatcatcagcgtatatttcagttcgattttgacttccttttcttgttgcattaataacttccagccaacgtatggccgtttggtaaaggtcaataattgttgggtcaacaaatcatcacgaatgttcattaaacgttcgtttaattcactacccttgaaaactgtttgttcgctatcggtttccttaattaattctcgtctttcagcttgcgtggtctgttcaaaattaagctctggataaagatttttcgtcgtgcgatcgactactttatttaagagttcatctgccttttttaatgagctttcctgttggttaatcgtcaataattttttagtcacatcttcaccaattgcatgtttaattaaggtactgttcttccaattaaatagcatgcgccgtttatcatctaagctctctaaactgatataagttttcagttcatgacttaactcattgaccacccgtttttcattaaacgagaaatgtttgcttagactatctaaatgacctctattgattactttttcttggttgtttttataactggctttggccttgcgatagttctttacttgttggttaaattcttttctttcatgccgcttgctattgattccctcatgttgagttggtatatcatctattccctgctcgataaatgatttttcactgatccgatccggaatatttttttgctctaaaacttgattgacactagccgcccaattgtgccgccattcagtaattttttcttttttatcccaatcaactagccacacctttcttgatcttggaaaacgactatttcctgtataagtcttgttcccattttcatctaatatattttcccttttacttttcaatccccatgttccgtctggattaaatggacgattagttagcataacatgagcgtgcggattatctaggttatctctatgaattgctacgtcggcaaccataccctcatcaacaaaattttcttgtacatattttgtcaataattctttctgttcgtcttcacttaattcaactggtaaagccacgttaaactcttttgcatagcgtgaatttgctcgccgatcttttctttcgacttcattccataatttctctctatcactcgcccattctggcgcattctttggtgtcaaaataaagctttctggcatgactgaccgagcataaaaatagcttcgaccttctttttgatcgaataacttttcaccacttctataacttgctccagcaattgcgcttcttccttttccagcactaatattactaaagctcatgtgaaaaattgccatgtcggtcaccacccttctttgggtttatgggtttgcttttgttgtcgccaacggcgacttctgatacaagggtttagcacaataacacaaccaactttagttgttgtgtgtaagtgcgcattaacctcgtttcactcggtctgctgattctcctgaatttatttttagtctatgccttccgcttcgttatttcaacttttatactttaacttaacgtttcctatatgatatagtttcggtgattatttctaatatgattggagggatcgttatgtctaaaagtaacttagaaaaacaagaagctaaattaaaaacccttaaccaaaaaatcaaggacgaaaaaaatgagattgaacaacgattaggcaaacaaattattagtcaagcaaatttagattatactaatttatctaatgataatatcaagtctttatccaaaaaagtagccgagtttttaaaagtaaatcaagcacataatcagttataaataatggagttatgtcatggctaatcaatataaaaaactagtcgaacagcaagcgcgtttaaagcaaaaaattgaacgggaggattttaaattacggcaatctaaatactatgaaagccgacaagaacgcaaagctcgttctcgccgattaattcaaaagggtgctttgcttgaaaaatattttcaagctaataacctctcggtcgaacaaaccgaagaacttttaaaaacatttgctgactatgttaacgcccataaaccggataaattaaaaaacgatcaacctaataactaggccgatcgtttttattttcaggattgttttttggcttaatttctggattgtgtttagcaaagtcttttaactgtttttgaattctttgtgtaagctctgctttactttctttgtgcttctttttacttgatcgctgttgaattatcttttgacccttacctcttctttttgattttaggtaaagcgtaaaatctgaaattttattttgatctagcttacttaaatgaccgatttctttaaagtttaaaccggctttgggaaagcgataaatattaccaagatcgacccaggaaggtttcttcaacccagcggattgccaatcttgaatcggataatattgttgcttgatataagccgacttcttttcatactgactagtaattttaaaagcctcgaccttctgttctgatacccgacgaattaaaactggccgagacttgccaccgttagtttctacaaaactaacgtatagactgactaagtcattagtcctcatctggatcattgagccaatcagcgacctctttagcgtctttgaactcggtgactggtgtcccttcggtcgcctttaaaaagcgtaaattagctctttcttcttcgcttaaagacgcattaaaaggtaaagcaccattagcaacaatccgcttgtaaaacatgttaatggccgtggttggatttaaacccaattcgcttaaaattgcttcggtatcatcggccaaatctttatcaatcttgacttggacccgtttcttttccttaactgccatgattgtctcatctcctttcttttactactaccattatactaccttttgagtaccttatcaatagataaagccttggcatcaaaccacttgagcttggcgttgatctaaaggctgaacttttgagctggttagcctggttagctctgacactcatttaaaagcccctattcttatgtttaagccatttaaatctaacttaatcaataaatgttagtaagtcttaaaatcgattagaaaggattttgtagccttttaggactagtagtacaacccactgttatcgttgtcggccgatttttcttcttcggggtgtttggccgcatactctctagccgcttgtttattccaacaaacgccaaataggttttgcatggtgccgtataagtagttctccacgttcttgatatgcctctcattgcttcttagggcgttaaagtagcgtctcaaggctttagtcatcaaaggttttagtgcttcgtcgtcaagcgggattaaaaccccaatatcttgatgatcctttttaactcggtatttagcatttaagataatgccaataaaacgatgcatttatttaagttagatacatattatatgtacgaaggcatttcatttacacaagattcttgacgctacctatctaagagataaaaaatctaagggcaattggtagcactaaattaagagatttcaccccgtacttatattggttccaaatctatctacttcatcatcaattccttcaatatctgaaaacacgctttgttcctcaatatactgcctattctgtaacttcaaaaaaacctcaaggtaattaacccaagctattgattctgcttctcttttccgatataaaataattttattttatactatgaaaaagcatctatacatgggtacatgatagtcgtattatacagatattgcgtttaggttaaagagagaatggggaatggggaaaggaaaattttatgaaaaataagatattaggaaataaattatttaaaagtggcaaagtgttgattgctgtcgcaggagtgtctgtaatcatgacaaatgctgtaatccctgttattagtacagcatcagcaaatacgaataaggtgacacctgttcatactgcttcaaactggagagctaacgaccaaaaaaccgctgaccaggctgccgctaagaaggctgccgctaagaaggccgccgctaagaaggctgccgctaagaaggctgccgctaagaaggccgctgctaagaaggctgccgctaagaaggccgccgctaagaaggctgccgctaagaaggctgctgctgaccaggctgccgctaagaaggccgctgctaagaaggctgctgctgaccaggctgccgctaagaaggccgctgctaagaaggctgctgctgaccaggctgccgctaagaaggccgctgctgaccaggctgccgctaagaaggctgctgctgaccaggctgccgctaacaaggctgccactaagaaggccaccgctagttccaactctgaatcagctacggtagatagctcttctagctcggaaactactaatccaaccgttgacaccccgttcgccgataaagctgttcacactatttatactggtactaatacttacctatataccactaaagagttaactaccattgccaccacaccattacaaggtgataccagcgtaattgcttatcccgatggcattacaacggccttaaccggtaagaatgctggtgacccagctatacccgtaacttataaaggacaaaacttgtattttaaaggtacttttgaaggcttgacttcaaacggcttatatccagatggctattactacgctttaacagacaccgccttctacggtgtggttaagccaaccgacccttccgtcaaacttgacgcaccttttctaaacggttccacttggttctacttttttgatggtggctcgacgatttacagttatcaaaataacgtttggacagccctgtaactgatactgctgaacaacacaatttgctcgacgatttacagttatcaaaataacgtttggacagccctagttcacaaaaggtttcgatcttaatttgttcggaataggttatactagacaaaagatcagctcctaaaagatgtgtttgtggtaaacaccattttaaaggaagctgatcttttttgtccgaacagcgttcggattaattttacaatctaccgtcgatcttggtaatatttatcgctttcccaaagccggtttaaactttaaagaaatcggtcatttaagtaagctagattaaaataaaatttcagattttacgcttgacctaaaatcaaaaagaagaggtaagggtcaaaagataattcaacagcgatcaagtaaaaggaagcacaaagaaagtaaagcagagcttacacaaagaattcaaaaacagttaaaagactttgctaaacacaatccagaaattaagccaaaaaacaatcctgaaaataaaaacgatcggcctagttattaggttgatcgttttttaatttatccggtttatgggcgttaacatagtcagcaaatgtttttaaaagctcttcggtttgttcgaccgaaaggttatcagcttgaaagtatttttctaataaagcccctttttgaattaatcggcgagaacgggctttgcgggcttgccgattttcatagtatttagattgccgtaatttaaaatcttcccgctcaattttttgctttaaacgcgcttgttgctcaaccagtttttcatattgattagacatggtataccccatctattatgattgatgatctacgggattttcctttaaaaattcagaaaattgtttggctaaaagcttaatccgatcgttagacaagttagcataatccaaattagctgatttaatgatttgcttaccgaggttttgttcaatcttatttttttcgtccttaattttttgattaagggcttttaatttagcttcttgtttttctaagttactttgagacataacgatcccttcaatcatattagaaataatcaccgaaattatatcatataggaaacgttaagtcaaaggataaaagttgaaatagcgaagcaaaaggcgtacactataagtaaatttaggagaatcagcaggccgagtgaaacgaggtcaatgcgcacttacaccccactaaattcttgtggggtaaataatgctaaaatcctgtattagaagtcgccgatgtcgacaacaaaatcaaacccataaacccaaagaaaggtggtgaccgacatggcaatttttcacatgagctttagtaatattagtgctggtaaaggacgaagtgcgattgccagtgccgcttatcgaagtggtgaaaagctatttgatgataaggaaggtcgccactatttttatgtccgatcgatcatgccagaaagctttattttgaccccaaaaaatgcaccagcatgggcgagtaatcgagaacagttgtggaatgaagttgaaaagaaagatcgtaaatcaaactcacggtacgctaaagagtttaatgtggctctaccagttgaattaagtaaagatgaacagaaagaattattgacaaaatatgtacaagaaaattttgttgatgaaggtatggttgccgatgtggcaattcatcgcgatcacccagataatccgcacgctcatgtgatgttaactaaccgtccatttaacccagacggaacgtggggaattaagagcaaaaagcaatatattttagatgataatggcaacaaaacatataccggaactagcaagtaccctaagagtagaaagatactgatggtcgattgggataaaaaagaaaaaataactgaatggcggcacaattgggcggcaagtgtaaatcaggctttagagcaaaaaaatattcccgatcggatcagcgaaaaatcatttatcgaggaaggaatagatgataccccaatgcaacacgagggaatcaatagcaaacggcatgaaagaaaagcatttaatcaacaagttaagagctatcgtaagtccaaagctggctataaaaatatgcaggagaaagtagttaatcgaggccacttggatagcctaagtaaacacttctcgtttaatgaaaaacgggtagttaaagagttaagccatgaactgaaaacttatatcagtttggagaacttagatgataagcggcgcatgctatttaattggaaaaacagcaccttaattaaacatgcggttggtgaagatgtgactaaacaattattgacaattaatcaacaagaaatctcactcaaaaaagcagatgaactcttaaataaagtggtcggtcgcacgacgaaaaaactttatccagagcttaattttgaacagaccacgcaagctgaaagacgagaattaattaaggaaaccgatagcgaacaaacagttttcaagggtagtgaattaaacgaacgtttaatgaacattcgtgatgatttgttgacccaacaattattgacctttaccaaacggccatacgttggctggaagttattaatgcaacaagaaagggaagtcaaaatcgagcttaaacatacgctgatgattcatgatgatagcttagaaagtctagaacacgttgatcaaggtctactagaaaagtattcaccaaccgagcagcaaaagattactcgagcagtcaaagacctacgggcaatcatggccgttaagcaagtcattcaaacgcaataccatgaagtattgaaaagagcctttccccatggtgatttagatgaactaccaatgattaaactggaacaggcctatacagcagtgatgtactatgatccagctttaaaaccgtgcaaggttgaaacaatcgcacagtggcagaaaaacccaccgaggtttttcaatacccaggaacatcaacaaggactatcttatttatcgggacagcttagcttagatcagttagagaatcatcacttacaacgggttttaaagcatgacggcactaaacaactcttttttggcgaatgcaaagccgatccgacgattaagaacagtcagatcgagaaaatccaaaagcagttaaaagggcaacaagccaaggacgaccagtacagaaaagcaaatatgggccattatcaaccgctaaattacaagccagttagtccagaatattacctaaagacggcctttagtgacgcaatcatggccgctctatatgcccgtgatgaagattaccaacgacaaagacaggcgcaaggtttaaagaagactgagtgggaaatgacgaaaaagcaacggcaacatcaaactcgaaaccggcatgaagatgggggcatgcacttgtaatcacaaaattagcgactggttaattggtatgaatggtagcccataatgtattttatattgataaaaatttggtacgtagagcgtgctcgattagttacgtatagctgccagctttgtgtatggtctatcaaagagaccaggtaaacaaaacctttaagccgaaaccttattttgaactaaatgctgaaattcttgctaattagcaagaattcgtcgcaaaattagacccctatcagcgatttaaagacgaaacagggctaataacattcatgcaagctaagcacgttcagaaaggctcacaggccggtttaatcaaggacgtccaaaaacaagacaaaaagcgtgctagtccacaactattctcactatccagtctgcaaagtgcgatgaataaacgttatcatgccagtgccagccaaaccttagcggccattcaaagtttatatgaagccaagttccttagctatccccgaaccgactgtgcttatatcactgatgaagaatttgattatttagtggctaatctgacgaagtatctgggtttggcctctaagccagtcgctttaaccaataccactccgaacaaacgctatgttgatgggaaaaaagttgaagagcactatgccattattatgactaaagtcgtcccgactaaagatcaattagctaccttacctaaaatacagcatcaagtctatgacttagttttaaaaacgacgttagcaatgtttgctgatccttacgaatatgaagaaacaaccattgttacccaagtcagcgatgctaattttaaagcaaccggtaaggtcccaactaagtaaggttgacttcccatacgtctaacaaacgcgcccaccttaccacagaaacagaggtttccctcaacataaaagcatacttatcgctgggggttacttctggagactggcaaagtaggcggcggctttttttaacatatcacgctccaatgctaattcgacattttcacgttttaaggcacggttctcagcttctaaagaagcaaacggcgtttgctttccatcttcggtatatagcttccgccaacgatacagggcactttcaggaacaccaagttcggaggcaatgattttaactggtttggaagagttcaaactcaaacgtaccgcatttttcttaaaatcttggtcgtagcgattgcgtgaataggtcattttgaggactcctttcggataaatcaattctcttatgtttctgtccgaaattctagtacagacccctttcaaatggcccactagaaggcattaaccgtaagatcaaagcgctaaagcgcagctgttatggatttgccaatcaagagcgcatgtttgaacggatttaccaactgattgcctagaaaagtcagtgtacgacacctcggggaggagtgtgcccaaaaacagggctacagagcataattgcagccatctaacttctaaaacggagtttttcggttcaataacaaaaaagcccactccgaagagtggacctttcaaaagataaaaactattaatcaacaccatttgacacagagccagaataataatattcttcagggccctctttaaataatctatattcactacagatataattatttaatggttaatcattacgacgtttcttgataccaagaaaaccgagtaaacttccaaacattgccaacaaaataccaataaatgacattgtttgactttgactattgttttcaccagtttgaggtaattctggtgaattaacagcaccgttgttaactttagatcctgtattagtcgacgtattgattactccattgttagtagcgttacttggctgggaaggattccctggttggttagaactgggatttcctgtgtccgtaccattacctggcttccccggttgattgagcccagtgccgccattgttatctgttgcggggttcttcgtgtaaacataggtaacagtctgatcatgatccgtaaagctccccgtagggttcccttggacttctttgaaggtgtagcctggcacatccttttgggtcgttgaatatggatcgcctacattaccagaagcaataacgtcgtcagcgattggattgccgttttcatcaacatacttagctgtgacgttgccgccagcaactggagtcttggtataggtaaccgtgaattctaagtcctttgagtccccattaactgtttgcttgtcaatttgcgccttgtcagctgtataaccctttaattcaggacttgtgactgcggcaaagctttgatctgctgaccaatgaccatacgtcttttccccagttactgcgtcagttgagacttgacgcgtaaaggtcacttgagcggtgttatcagcaggagtttgattaccagcgccttgataatgaatagtttctgtaacggttttggcctctgtagactgaatgttttgatgcttcaagtgaaccgtgaagttctgatcagttgtgtcatcattgtcgaatgtcaaatctgctggatagccatcattaaccaactgatacccttgtttcttataatccgcaatgctgccactggtactataactggatttcgagcccgttgttcctgaaattgaatccgtctttaaagtttttccggtcgtatcatcaacgtagctgacactacctttttgcttatctgctgtataggtgatcgttgtatctttcgttggatcacttggctgataactgctacctggtgtcaaaacatgaccttctggatcatgtgctgtataacctgttaccgtcggtacaccggctggtgtaaccttcgtcgcatcacttgggtcatttggatagaccactgttggtgctccagggaagttcccatcacttgagcttggtaccaatgatccgactttcgtgtatgtcacggtctcattaacatctgctgaatcggcattcaggtcagttacggcagctgtctgcgctttatcagctacagatcccggcaccactgggctaacaacggcatcaaaggtcgtatcaccatttgtcgctgtccaggctgttgttccagcaccacttgtaataacttcaccagtaacgttatcgacaacgaccgttcgtgtgaaattaacagaatcagtgtgttgcttggccactacgtgtccattctgatcaacatagctgacggtctcattgaccgtcttatcatagttggtgctagttggccactttggtccatctggttcatctggattgattggcgctcccggtgtctgtggatccgttggattcactggcgtcagttgatgcttcaagtgaaccgtaaagttctgatcagttgtgtcatcattgtcgaatgtcaaatctgctggatagccatcattaaccaactgatacccttgtttcttataatccgcaatgctgccactggtactataactggatttcgagcccgttgttcctgaaattgaatccgtctttaaagtttttccggtcgtatcatcaacgtagctgacactacctttttgcttatctgctgtataggtgatcgttgtatctttcgttggatcacttggctgataactgctacctggtgtcaaaacatgaccttctggatcatgtgctgtataacctgttaccgtcggtacaccggctggtgtaaccttcgtcgcatcacttgggtcatttggatagaccactgttggtgctccagggaagttcccatcacttgagcttggtaccaatgatccgactttcgtgtatgtcacggtctcattaacatctgctgaatcggcattcaggtcagttacggcagctgtctgcgctttatcagctacagatcccggcaccactgggctaacaacggcatcaaaggtcgtatcaccatttgtcgctgtccaggctgttgttccagcaccacttgtaataacttcaccagtaacgttatcgacaactaccgttcgtgtgaaattaacagaatcagtgtgctgcttggccactacgtgtccattctgatcaacatagctgacggtctcattgaccgtcttatcatagttggtgctagttggccactttggtccatctggttcatctggattaattggtttacctggtgtttgtggattcttcggaccaaccggcgttgtgccatgagttaaatgaacctcgaacttttgaacggtaccatcttggttataaaccacaccattagttggataattgtctgagactaattgatacccttgtttttcataatcggcaatggtgtcacccgtccgataaggatcagttgaaccatagtcgccagtcaagtccttagtgcttaaggttttaccagtcgtatcatcgatataagtgacgttggcggcttcttggtttggtgtataagtcacagtgaagtccaaattaccagaattactatcaatacttttaacagttgtctgtgttaaatcgttacttggatcagttgtggacacgacatgttgaccaataacatttgggttgataattgccgcaaaatctgtactattgccccgagtccaattacctactggtacaccattattatcaagagttggttgaccagattcagtcgttgaatagtatgtcgctgtcgaaccatcaatcggattggtaattgttacaaaacgagttggtattccactggcatcatttgcaactggttgaccatcttgaccaatatagtgtacggtttcggttaccgtcttaacctcactaatactgtaagctggtgcataaacaaccgtaaaatttaaatcatcagacgtgttgttaacagtttgaatggcaacgctatttagatcagagcccggagcagtggcactgataaccttatatcccttaactgttgggttatcaatagcaccaaatttagcattatcggcctgaatccagctgctatcgggtttacccgcattgtctaaagttgggttctcctgactgccgaacttataatacgtggtagtcccatcccatgctttaactgtgataaaggtaatagggttagcggtatcactaggggcgacttttttaccagtttggtcaacatagttaatagtctcattaacttttttgttaataacaattgagtaagtgacaaagttcaaaaaataagagttcttattatgattaccatgccaccaagaagtgtttgaaggccaccaagaagtgtttgaagcatcgattggaaccgcgcctaggtaaagtgttggtttagtcgaagtaaaatcggtaaaggtcactcccccttgtagagcataataatccggattactatcctcaccatcatgtgactgataaccccaaggatcggtgtttgtatagactaaaccatctggaacattgctaccagaaacacttgtgagtcccattgttgatgctggtgctgtgaatcctgttgatggatcattaataggattttttgagatgactacggttttggcatcattggtttgaacgtattcacggcggttcacatttacaccattatcagagcttaatgaggcagacaaaaaataaaaaatttgattgttattttgagcagcattagcctgatcaaatttggtaatgtctacgattgagccatcatcagagtaagtaaaccagaaggtttcttggaagttggcattgtagacatcgatgttatcaacagcattcgagctaattaaaataagatacgggttttttgtatcgatacccgttatgctactaataccataagtactcgggttattttgagcaacgaaatcatgaaatgtttcatgaaagtcaacatttcgtccattaattgatccggcgttagcccaattctttgtaatagatacattactatttaaaagatcagcccctgaatacaaccaaaatgtgtccccagtcataccatcattcttaaattgattaggcagattagcctgggtgtacgtacctgttaaatttaccccagttgcagttggagcattgctatcttgagagttcgattcaaagcttaaattttgagcattatctaatgatgaatactgggttttaccatcacgattcgtttgagaagttgcattatcggccattagctgaacaaaactcttcgtatcactggcactgcttgctacagtagctgctgattgagcagcactcttcgtatcactggcactgtttgctgcagtagctactgattgttgagcagcactcttcgtatcactggcactgcttgctacagtagctgctgattgagcagcactcttcgtatcactggcactgcttgtattggtcgtttcagtctttactgcactgctgctacttgcactggtcgtttcagcccttactgcactaattgatgtactggtagctgctgatgaaacagcgctcttcgtatcactagtgctgtttacattggcggtagttaagttccctgaggtggtatcagcatgaactgctaccgttgataccccaccgaatacaaaaaaagacattgtagcaattgctgcaaacacgaattttttgccatctttatacattttataatgtaatttcttttctaccattataaacttccttcccgctcaattatattgagctaacctatttttaatgagcaatgaacttataaaatatgatcctgaacttaataccattcccttacgtaaattcacccctattgaaatgaatctatttttttcaattatttctcgcatgcgtgataagggagatcagacagttagattttcttttgaacaacttaaagatttgagcaactataaaccgactgcaaataatcgctttgaagatgatattcaaagaacttacgaaaagttaatgggacttcattttggaagacgtagtaaatctggattaaatagagaaatgtttgttatgtttactaaattcagaattgttggtgaaactgattctccttatatagacattgaagtatataaagatgctttgccacttcttaataatttagacacgtgggttagatatgctttagcggaatttagagatcttcgaagcagttatgctaaaaccgcttttagattgttaaaaggtttcagaacaaccggttatgcttttttatcaaaagaagatttttttgagttacttgatattcctaaaagttattggaaaaaaccgggagacgttgatagatacgttcttaaaccaatcagagaagaattgacccctctttttagaggcctaactgttcgaaagaaatatggtaaaggccgcgggaaaccagtgattgggtattcttttacttggaagcctgaaaagaaagacgctaatgacttctcacaaggtcaatttcaagatgaacgtcaaaaactctttaacattcagcataatggtgaattaacagagcaggaaaagtggcgcgccattgacaaggttaaggggttaaccttaggctctactgagaagcaagcattggctgataaacaggccgagcacgataaaaaaataagagatcaagcaagacaagaagcacttgctgaactccgaaaggggtttggaaataatgcctaaaacaattagagaacttgctgatgaattgggcgtttcaaagcaaagaattcaacaaatcatcgccaaattatcggcaagcaaaacaccaaataaggaaggcaatagatacgttttaaacgcccaagatgtcaaaaatataaaggatttgatgggttttgataatgacaagtcatcgacaagtgaatcgacaaatagacttgtcgattatgatgtttacttagatgtgatagattccataaaagaaaaagatgaacagataaaaattttattagaagttcaaaaacaaacacaaaatcttctagatcagcaacaacggttagcattacaggataaaaaaattttagaagaatataaggcagagatcaaagatttaaaagcattaaatatgccgccacaagatataaaaaaagagaattcttctccaaaagaaacaacagactatataaaagaatcgccacaaaagccaaataaaaaaaagtggtggcaatttaaaaaaacgagggcaaaaaaatgattgattcaaaaattatggagacaacaaagtctattttgaaggaatttggtaacacatacttttcagataaaggcactctaaagcgcaacaaagtaatagaagaccttgatacttatacacctatgttgatggaagcattgcatttaagtttatggtgtatcatggtgttatacaaattaaaattataggtggtttagaatgaaaaaaatttattttttatgtacaggaaattcttgtcgcagtcaaatggctgaaggatatgcaaaaaaaatattgccggcaaatgagtttcaaatcgagagtgcagggattgaaactcatgggttaaatctaaacgctgttaaagttatggctgaagatggagtagatattagtagccactactctaaattaattgatctaaattatttgaacacttcagatttagttattactttatgtggtgatgccaaggataaatgtcctatgcttccccctcaaaccaagagtttacactggcctttatctgacccagcgcaagccacaggaactttagaagaacaactacaagaattccgtaaggttcgtgacgaaattgaaaaattagttacaagtttgaataactacgttcattaataaaaaaacgccatatagtgccgcagtaaaacggtccaattaatttattgacttctaaggaaaataccagggctttggttatgagctagatatgtgactaggcactcactaaaatacccttccattcagggtctatatttataaattagataatacattagaagctggagacaagattgtctagataatgtgtgagataaaatttttggcaggttatcatacataagacaaaatgtttttaaaactgataacgtatttatttcacaacaattacgcatttatttttgagaaaaatataaagcaggaggattacaatgctgaaaaattattctttaacaaaagatacattattagtttcgtcagaatcaaatatcaaaaattcttctgttgtttatgtttatggtgacgaacgagaatatatcgaatctattgaacataaatatgaccttaaaataggcaatatactaacgtttgatgatcaagttgcatatgacacgatgatagatcggaacgatgaaaaaagtttgctcgtaagttttttgtttcccgaggtacatgaaggtgggcatctagataatctgacgacatctgttgttttcttggtatttaaaaataagttgataatttttacaaaacaaaaattaaaattcattcccgaactcttatccaatatggttttacgtgatgtcaataatttcacggaggaagtacttttaaagatcatgcaaaaagatttccatgtgatgcttaacaaccttcgtggagtcaaggaaaaaattgatgatttagactcagaaatatcaacgtccggtccactcagaccaacgtttgatgatttattgactcttcaaaaatacatgatagctttgtcaacaacctatggcgctaatcacaaagcgctggatttcattaaaaaaaatttcacaactattaatgatattgattttaccaccaaaaaaataattgatgagatatatgatacaagcgacacaatggatagaattattttaggttacagccaatatttggatgatttggaagatatgatagacaatatgatttcttatcagcttaacatgattatgaaaactctaacagagatatcaatcgttttgactattccagcgattatttttggtttttggggaatcaatgtcgatgtcccgtttgaaaaatcttcttatggtttttttgctgtgttgattatctctgttatactaagcctaatttgctggttttggttacgacgcaaaaaatatttctaaagtatttgtgataccctaatatgatttaaagcagaatttctttgttcaacgaaaacccgcttcaggttgtattaactgaagcgggttttccgttgtttaaatattaatttcggcgaaaatgaagttctgtcaattgtttcatttgcgttatatcaattaattccaaccgagtttgatagtcggattgctcgaataatctttttccgttaccaagtaaaacgggtgcgatttgaatccaccatttatcaatcaagtcagcaacaataatgttttttagtaggttcacaccaccgaccacccaaatattgcccgacggttgttctttcaactttctaaggtagtctactggatcctcggatacggcaaaaccttcttggacatcgaaattagtattatgggtaaacaccacaacatccttaccgggatataaaggctggacgtactttcgggcctcttcgtatgtaattctgcccatcacaacagtttctaccgtatccaaaaaggcatctgtggtaagtttatcaccgacttctgtatcaaataaccattgtaatccatcgttcacatcggataggtagccatccaaactaacagcgccataaaagaaaattttagccacgttattccctcatttcttaatctgttgcaagtataacaagtcttgcacaaatatgataattggtatattcaataaagctgtggaaaggcacagagtggtccgctcttcaccccgcaacaaataaacctacggcttgtgaatttttaaaaatcacaaactaggcgctgtaaacgttgatatagcaacaactacgcataatcaaatgttatgtaaatcagataatgaaaagaagtcagataaatactaatatagcgagaccaatatttatctcttttcttcaccagtgaatataaatgttcaacatgcttatctaagcgggggctataactatcaaatagtccatttttttagtataagagcagtaaaaccagacgtggaaaccacgtggtcttttagttgattcagtaaaagaagccgaagccaaagtgaagacgttggtttcggcttctttggcttttaattgcgggaacgcacacaaagagccaaaaaagattactgacagccatcttctgatggctgccagtaatcttttttaagttcttgttcaaagggtttgataaaatcaaagctagaaactagttccggtcatgcttgttgcgatcattatcgcgtaagtcttctacgtgggcatcaccactcgtatcgacatctagttcttcgtggctgacgttttcacttacttgtttcatatcttcgtgttcttttttacgaatatcaacttcttctcgaacgaccgggcgttttttgacatcgatctgttcttctttgattgggatcgtgatcgtgtcgtcttcttgcgtatcattgacatcggtagttgcagccgcaccatctccgggctttctttcgatcacgatttcttctcgtttaaccggtacgtcgactgttttcgtctcattgacaacatttttatggatatcgactttacccgtcgtcacatcatgcttattgatatccaattgttcttctttaagctggatactatcagtatcagtatctagatcagttgcatgtgcagcatctgatgcatgtaaactatttgtgcgagtggcaccagctgcatgtctgcctgtaacattttcagttgcttgtgttgggtcgtttttataattattgacggtgataataatttttccagctgagatatcatctctatattggtaaagcgggtcgttgtttgcatggtcagcttcttcatttgaacttgaatcgtattcgtacgtatcagcagaaaatgcatctttgattttttcccatagtgactgatcttcgtgagtcgtttcgacgccatttacgccggttttaacatcgattcctgacagtccagcaaaaccaaaatttttagctgcatctttgttggtgtaaataatgatatcatcacggctatagccttctctttgcagttgttcgatcacggataaagcttcttctctcgtactgtaacttccaataacttttaaatttctttccaacatataaatgcctcccatttcagctattttatgaatacgcttacaattatagtataacgaataaatgacgttaaaacaaataatacgaatgttgagaattaactaccgccttacactacgtttcagttggtataccccgcatttagtgttccttttcaaaaccagaaaagaaacactaaacacagggttctgttgagaagaaaaggagtaactaatggtagattgcaaatttaatccgaatttttggacaaatttgcaatctaccactttatcattttggccaaacgatgtgcgaacaaaacaggtattattaaaattgctagtttctgaggcaaacaaaaagcagtttacgcaatcaccttctgattgcaaaacctgcttttggcttctctcttaccgtcaagccacgcaattactggacttggccttttttaaccaacactggcaaaataatgacccgatccatgtaactcggacgatgcatgaaggtgcctgcttcacgataagctttggcaccactttcaaagatcatcgaaatgtgcttctcagaaggatcaaggctgatgtcttcaaccgagtttggcacgttaataattttagatcttgactttggtgcagttaagtctagtttggtccagcttttattgcccggaaccagaatccagattttgcctggtgcgctgccatttgactgactgagcaacgtcagcccacttttggcaatggcaatgccttgaagccgatccaagccattgttagacgaattaatgactttcttttgaatcggcgatttaaagaccatgttaacttcttgattgagtgttttgccggtaaactttggtgcaagttccaaagcccatgctttcatttgcttcatcgtgatgggtgctggcagcccatttgcattgagcggtaaggcaaagatcgaacggttctttttgttctgaccatatttaacaaaaaacaattgattgttatatagggtaatcgctgaggtcgctcttggcaaatggagttcaatccgggttgactttatcggttgttgcgttgctttagccgaataggcatcgatttcgcgctgtgacacataactgataccagcaccttttgtctgcgcggcatcatcagaccaaagcagccgctgatggtcgatgtcgtaagtgataccaccaacgtgcgatttgctccttaaaattaaggttttattgtacttagcattatgcttgttcacctgaacaatgattgaattcagtttgtgattaccatcatacaagctcatatagattgcatctttggactgggtgaccccttgaggcacccagttattgccaaaacccgcttttttggttttagcattgatcgaccaagcaccgcgaagtccaggaatcaccactaatttggcattggtggccgcgcgtttttcaagtggatctgattgccccatagctttaatttgcttaattgccgcgcttttggactgcaacggccgcggatcagcttcccattttttaacatcacttggctgatcaactaactggctgtactgataatgatcaatcaacgcccagccgccaaagccaagtacaacgataccgatgactgacaataccgtcacccaaacccattttttcaacatgcatacactccttcatatcagaattataatatatttgaattaaccacgcgattatattacccggtaattgccagaaaaaagcaaaaggcgggagtgtcaagaagtttgtgtaaatgggaatccctttcccctgtaaaattaaaccattaatcgaaaagtgaacgctttaatcggaatttacgttatttttacaatctaccttatctgtaacaatttctggtcttatatcaacaattgtgtcgcttttttttgtgccttataattaaaggtgttaaaatacgtcataacttaccaccataaagcagtccaattaatttattgacttctaagtaaaatacccggagttttgctatgagttaactatgatcctaggtggtcactaaaacattccttaattcaggggttataatatacaaataacccctcaaaaacgttgttaaaataacccccaatatctataatgtagatgttgggggttatttgtttttatatggtataaatgacttctcttattcgtcattttttcgataccttttggaacgattttgaccaggaaataaacgatcatgcgatccgactcgaatgccaattaagactagttcatctttatcaatcgtataaaccaccaggacatcgttagtttcgcttggtgttttgtttttcggggtatctcgtaagtgaaattcattataaccgctcattcgccgattaagctcatgatcttcaaattctgatggtaattgttgttgctcaagcaacaggtcaatggctgctcgaacttcatcaataatagatttgtctaaactggctaaccgttttagatcagcattaaaggttgcacgtggtttaaatcttagttttttcattatttaaactgaccccaataatcatcatctgattcaacaatttcatcgtcaggtaaaacatggcgtttaattaactgatcacgtgcaattgcatattctaacgagccttctttagcttttaatgctcgttctagccaatccattttttcttgtgaaacgatggccactgcgcgactatttgaacgagcaatataaacggtttcgtcttcgtcattaacttgatctaaatatttttttaagttagcgcgaaaatcgctctgtgttaatgctaatgtcatatttaccaccctttctttgtacttaatattgtactttaatttgtactaaaaatcaaaaattttaaaggagctcaaactatgcaacaaattgtcttaccaatcaaagattcaaatgtgctcaaagaagtgcaagatacgttactccataatttcaaagctggttggcgtaactataccgtttttcaagtgggtaaagcgactctgttgcgagtgagcgacgttatgaagcttcgttggacagatgtctttaacgaaaacggcaccgtgcgtcagaatgcgtttatacacgaccaaaagaccggtaaagctaacctgctctacttaaaacccgtgcaaactgatttattagcctatcaagcttggttgcaagaaaaccatttggtttctgactggttgtttccctcgattcagcacccagaacgacatatcacggaaaaacagttctacaaaatcatgagcaaggttggcgatctgttaggaattaattatctagggacccatacgatgcgtaaaaccggggcttatcgcgtttacacgcaatcaaattataatattggcttagtcatgaatttgctaaatcattccagtgaagcaatgactttagcttatttaggcttagaccaggctagtactgaaacgatgctggataaaattgattttggttaggaggctggctttatggatttagattttaaatcaaacaagtatgatctttttgatgattggcatcaaaacaagactaaacaagcctttacacaaaagttgcagcaacaagctcaacttgaaaaaacacagctgccacagttattgtcgcgtgaagatttaaaaattcgctggcagatgaactctcgtcaaagtgttcatcaagttgctagtaagcctgattttccgcaacccgtttttgcttttaatcatggtaagacaccactttacttagcaactgaaattcaaattttcgaaattaatcacccttgggtaataactcccggtgctcgtctcgcttatagtcattggatccttcgtaatgtgattgattaatcttaagatttaactctaggtttttgatagttggcgttagccttctaatacaaataaaccccatcaaaatggggattaaatctacccttgacacttgtcaagggtgtaagtgcgcattgacctcgtttcactcggtctgctgataaccatagaatcgattttttccgttgttgaatggaatgtattcttaattcaatttatgcttacacttaactgagtttgttatgctttaaatgctaaaaattgttgcatatcccgctgctttcaaccaaaatttgaataactaactatcaagaattacgtatctaacctggacgaaaagaaagtattaaaacccattgacgaaattctctctgatccttggcaggttgatattcaagaattatttaaagcttctgtcaatgaacctgacgagattaaaaagaatttgtatgattccctgtatacttacattttgcaaaaaagacaagaagatattattaatcgtcctggcttcgttattcagccctctaagagcctgttgagggctttttatttttgctttggtatagataatataaacagtctcaaaaccgctaaaaacgaaaaataaggcccttaaaaacgaacatagccgctaaattcttgttaagattcagaaaaactaactgtttgctgtcaatggtagtggacgagcgcagcgtgggagcataaggaattgacagctcttaaccagtctttacactgaaatggcgaaagccaaagtttctacaaaactttgctttcctgcctaacggcgagtgaaaagcggttaagctagctcatcttggacggggtgcggggcgtcagcgcccgagctaatgtgacaagccacatctttgtgttttttgattctaggttttgatctcgtacagtagtgcctcttatatacctcttttataaacctcttttaaacctcttttagacccctttttagtcttactctcccaaggcttatagaagtttatcaacgaggttttgtctgtttatcaacgaggttttgtctgtttatcaacgaggttttgtctgtttatcaacgaggttttgtctgtttatcaacgaggtttttaatggtgatcgttgataaacaatcgttgattttatataatagttgtggaggtgtgattttgttgaatagccaatgccatattctctggccagttgggcagctgattcgccctgcttatatagtttgataatgttttgtttgaattctttgtcgtaacgagttggcatgtaaaaattccttccttttgagaaacgatttattcattataccctctcttaaaagttgtctcaggaatcagcttacatccaaccccgatatcattatctttcttgtacaaatcattccatttataaatggtggcactggcaatcccatattcgctggtaagatcagtgactgatgtcccgctttcatacagctgaacgatcattttcttgaattcgacagaatatctctttcttttgctcataagacacgatcctctctagtagaaattctatcaaatcgtgtccacactttcatcctaagtccactcaatgggcattggtacttgtttgatactgtaaccttcttaatgaaaaacggcttccaatatatcgccaaccagcataaaattgtttactacaataacaacgggcaaatgctttatggctttcaaaaaaaatcaaaggcaaaacatatcacttcaatactcaaactggagctcgtatttaactaattttctaggactgtagcgaatctgctgcagtttttttattcatattaattgagaaaataattttgattgaataaatttgttaaccgttgtatattatgtttagttacagatgtaacaaatacttggtatcttattttacaaggagggatttttatgtactacagtagtggtaattatgaagcatttgctcggcctaaaaaaccagcaaacgccaccaagaaatcagcctatattgttggggccggtttagccggtttagctgccgccgcttttttagtgcgcgatggtcaggttcctggaaaccaaattcatgtttttgaagaacttggacttcccggtggcagcatggatgggattttaaatgaacaacgcggctatattattcgtggtgggcgtgaaatggaacctcactttgaaactctttgggatctttttcgttcaattcctaccttagaagatgccagtgtttcggtacttgacgaattctattggctaaataaagccgatccaagtaattcacacacccgcgtaatcgaaaaacgtggtaatcagttagccagtgatggtcagttgacgctttcccgaaaagcaattgaagaaatcgccaaattagtgctaacaccggaaaaccaacttgacaatgtcaaaattaatcaagttttcagcgatgacttctttaaatcaaatttctggctctattggtccaccatgtttgctttcgagccttgggcaagtgcaatggaaatgcgccgttatttattacgctttgtccatcatgttggcaccttgcaaaatatgtcagcattgaaatttaccaaatataatcaatatgagtcattaatcaaaccactgattaaatatcttgaagatcacgacgttaaattccaatacaataccactgttgacaatattattgttgaacaaaccggtgaacaaaaacaagctgttaaaattgagctaacgatcgatggtaatcagcaaagcctcgacctaacacctgacgatttggttttcgttacaaatggatcaattactgaaagtactacttatggtgataacgaccatccagctccagcaacgcatccaaccggtgctagttggaaattatgggaaaaattagcggctcaagactcagctttcggacatccagctaaattttatcaagatattccagcggctaactgggtcatgtcggcaacttgcacctttaaagacgatcgaatcgtaccctatattcaaaaaattactggtaaagatccgtatagtggttcaattgttaccagtggcccagtctccattagggactcaaactggttattaggaatttccatcagccgtcaaccacattttcaacaacaaaagccaaatgaattaatcgtatggttatatggtctcttttccgatcagcccggaaattatattcacaaaaaaattactgattgcagtggcgcagaaatctgtcaagaatttctttatcatattggtgtcccagaaaatcaaattgctgagatcgcgcaaacagctaattcaattccaattcatatgccatacattacttcatactttatgccacgccaagctggtgatcgtcccttagttgtccctgaaggttcaagcaatttggcttttattgggaactttgccgaaactgagcgagacaccgtctttacaactgaatactctgtcagaactgctatggaagctgtctaccgactgcttgacattgatcgtggcatcccagaagtctttgattctgcctttgacttacgagcaatcttaagtgccttatattatttgaatgataaaaagagcttgaccgaattgcctttaaatcaaattgaaaaaattggtctaaatgcctttttgaaaaaggttcatggcacctatcttgaagaaattttgaaatctcaaaagttactctaaatcaaaggaggaaaaattcatgaaaaagcagcatttaattttaatttcaatcgctttagctactggggttgtaattggaaaatatcttaaaccccaaaaagacagttgctgtcgtcatcgactaggttgttgctcaaaggattcacaaatctctaagaccgatccagtttatttacgagaaacccaaaccctagggcatggcctaacaaagtaatttagcctagtaaaagggggcactgcaaaagtaaaattgccgtgccccttttttgattgttttgtttttccattaaccggctaaaatattttttcgccagtttgcagtaaatcatttttgatcttttctgctaggtgctcggccaactcggctgcggaatattgataatcgttttctcgccaatatagtaaactagcaaaaatagcgcccgaataatatgcaatctctattggtactggctgctgatttttaattcgcgttttaaaaaaatcaagcaagtagtcactttgctttcgaagagcaaagccttcaattgaggcgctaacaattgccgataaaacagctggattatttttaaaataatcaaaataaacttccaacaactgctctaattctttaaaatgatgcgtcgtaatgtcatcaacaaaagttgcatattctttttgaataaacttgttcaaaatatcttccttactgttatagttgcgataaaaagccattcgtgatatttttgcttgattagcaatatccgtaattgaaatttctgaaaagtcttgttcttgcatcaattcaaacaaagctttttcagctttagcttgcgtccgcacaatccttttgtccatagtcactatctcccaattaatgaatcaatttagttgttgataccaattatacatcattgaaaatttcaaaccgctttacgaaaaaaagtatcaaaatcaggtcactaactttgatactttttttacttaatagttacttttttagttaggcttttcggtatctactgaaattaaagttttgatgggtataccagcatagtcaaagtatcagaatgggacttttgtactcagtattgaaactttgcaacagaaccttgctttaaatgactgggggggagaaaatagactaaagcaggttattttagtgaaaacttttaataatgatttatagatttttatctgctgtttaagatgccagcagcttgcccccattaaaataattggtaaatgtaagtgtataataaaattttggcggactaacctgctcaggagtcaatagattgggcttttgatcaacagtcaccacagttttgggcttgcgataacgtttttgcatgcgggatttattccctaattcacgcatcaatttgagtgtcatatactcagatactttcggcccgtcggtttgttgactataagcagtaatacgacgataaccataaaatttaaaggttctccaaacgtctaaaatataaggttttagagattctctacgctttgcttgtcgactgggctaccaatggagccagttgtaataggtactaggtttgattttaagtgcacttaaaatactcacaagcgcgtagcttagtactaaaaattggttaacaagcggcaatcccacattacggactattttttggctagtaagatggccgctcgctttaaaatttcgttttcttcctccaaaatagcgagacgattttctaattgcttgacccaaagagcaatagaaccttttgaaggcccaaatacctctgccaatgatttaagttaacgtccttcttggtgaagtttaaccaatgaatctttgaaattttgtgaataacgaattgacataaaaatactcctatactttcattttacggactgaataaaaatagtccatttttttagtataagagcattaaaaacttgaaaatatcctgtattaatttgtgtaagcattattaaactatattatttagtaagtgatataattatcatactttagaagcaaaaggagaatagaaaatggggattatttggaccttaatagtcggtgcaataattggagcagtagccggagcgcttactagtcgaggtgctgctatgggttggattagcaatatacttgctggactaattggctcatggttaggcgaaagtttgttaggtaactgggggcctagtcttgctggcatggcattagtgccttctatcataggagcagttattctagtaattattgtttcttggatcacaactcgaatcaaacattgaaataaaaggggaattttgatcatagcagaagaaaataatgaagtaaaaaagcaaaataaaaaagatgatcctaaatctaatgataaagaaaatatttttgatcataatgatcagactgcagattataagaaggcagaccagaatcatgggattttagattactacgcgagccctaaattgcttttacagtgtttgggcttttttttaagcgaatatttttttgaaattagaaactttttaggaatttgatgaaaaacagtatagaaaattaaagaaagaaaaaagaaaaatgacgagtaaaaaacctaatttaaaatttttgaattattgtgtttatgtaatatctttgggaggctttttatttggttacgacacaggagtaataaatggagcgctagcttttatgagccgtccagatcaacttaatcttaacccttccttacaaggcgtagtatcgagttcccttgtaattggtgcttgtattggagcattaggatgtgggaagatagccgatcaagtagggaggaaaaaaacgctacgcttgattgcaattatttttaccatatcaacctttctttgtgcattagctattaatttctggttcatggctatttttagatttattttagggattgccgtgggagcagcatcgagtctttcaccaatgtatttagctgaaatatcgccagataatttacgcagcgcgaatgttaataacaatgctatttttattgttcttggtcaactcagcgcctttgttgtcaatgctattttaggaaacatctggggtcactggggtcctatatggcgtattatggtcttatctgcggcagttccagcggtgattttatggattaattcatttcgaatcagtggaagtccacagtggcttttgttcaaaggacgagttaataaagctagacaattatttcgtcggttagggttcagcaatactaaacagctcgtaataagtggaactgaaacgattgatgaatctgatgatcaagaatttagctggtcggttgctttgaaaaataaaaaattactttatttattaactaccggaatagttattgcgttgattcaacaaatttctggtgttaataccgtcatgtattatggcacgattttacttgaaaatgtgggaatgggggccggaggctcactctacgcaaatattttaataggtgtggtgtcagttattgctagtatctttggtacgcgtacgattgaaaaagctaatcatcataaaatgctagttattggtttgattggcaatgtcgttttcttagcactattaggtttgattatgaaaacaacgatgttttcgcagaccataacaaatgtattggtactgatcgctttgactttattcttggccaatcatcaaggtattgttagcccggtcacatggttattattagcagaaatgtttccgggaaaagttaaagcacaatttatgtcagtcgcaacggcgacaacgtggattactaactttattattagtttaatttatccgcagcttattgcattgttaggaacagctattgttttcttcgtctttgcactaaccaacggtcttagtatcttgttatccgttatatttgtgaatggtcgtaaaataaaaaaagcatatgaaaatgctgaagtataaaaataaaaggagtattaattcacatggcaaacttttatgttaacacaacagaggttgtgcacaaacttcctaataatgatcgaccaaaattttacatgtttggtgttccaagctacacgaacatgggggatcaagcagtttcgttagcagaacgaaaatatattgaaaacgaattccccgaatatcaatatattgaaattattgaagaagacgatgactatgctattcccattgtccaagagcatttacagtcctctgatattattgcgtttactggcgggggaaatatgggtaatttgtaccataatcatgaggaggcacggcgtaaggttttttcaacttttgtgaacaatctgacaatttcatttcctcaatcaatacattttgaagacaatgaagatggtgagattgaaaaacaaaagagtcaagaggcttaccggaaaaatcctaatctcgtgttagtggcacgtgatgctcaaagttttcatcgtatgcaatcaacgtttgataacccagtcattttcacacctgacatggttttatacatgaattctatcaactggaagttcaatcgaaatggggctttattcgttttacggcatgattcagaaaaagttgttaaaaaaactacgattgacaatataaaagatattttaggaaatgaacgccctgtaaaaagagttgataccgttctagatgaaccacaaaagataacacctgttactcgggaggcattatttgattcagaactagaactattctcgcaccaggaaataattattacagatcgctggcatgcaatggtattttccgttttaacaggaacaccttgtttgttatttggaaatagttatggaaaaggaaagcatgcctatattgattggttagagcacgtcgactggatcgattacacggacgaaactgacgtagagcgtatagaagaactgttacaacagctaatttcgcaaaagcggcacgattacgacgtaaaaaatgattttcgtcaattacgtgatttaattaaaaataatatgcacaataagaactaataattattgattatcaaaaattgaatatcaaaattattggtaataaaaagaatagaaaatgtatgggctataatgggttctgttgcaaagtttcaatactgagtacaaaagtcccattctgatactttgactatgctggtatacccatcaaaactttaatttcagtagataccgaaaagccgaagagcgttccatttcttcggttctttttgtatatgcctctcaatgcttctatgcccttaatcgtagttgatgcagtacgaagactttgataaagtttatttcgacgtttaacaggtctatgatcttgctcaattaagttattgagatacttgactgcccggtgctcagtttcgctgtatagcccctgcttttgtaacttcctaaaagcactagcaattgatggtgctttatctgtcacgataactttcggttccccaaactgcttgtatagtcgtttaaagaaagcataagcagactgagtatttctctttcgtcttagccaaatatccagtgtcatgccttctgagtcgattgcacgatagagataatgccacttccctttaattttaatataagcttcgtccattttccacgaataaaaggactgtctatttttctttttccagatttgatagatcagcttaccatattcttgaacccaacggtaaattgttgtgtgagaaacgttaatgccacgatcatataacatctcttgaacatcacgataactcaaattatagcgaagataatacccaacagagataataatcacgtctttttggaattgtttgcccttaaaatgattcatctgttgtcctcgcattcttttttattacattttacaataaatcaggtgttatggggaactttgcaacagaaccaataacttgtatgcaaatattcaattgcctataattagatttagaagaatgcaatttagataatggaggatttcatatgaaaagatttggactttggtcaaaattatcaattatcatttctatatctcaacttttattagccatttttaaagaaattcaaaactataacaaatctaaaaaacatccttcgaaaaataagagaggatgatgttttatgcattggttatgggttttaattattggtgccatcattggtgctattgctggagcaattactagcaaaggaaaatcaatggggtggattgctaatattgttgccggattagttggttcctctgttggagaagctatactcggatcttggggccctcaattagccggaatggcaattattccttcaattattggagcagtaattgttgttgctgtagtttctttctttgtcggtaaatcaaagaattagtttttaagcttcatttaaggttcttatactaaattatagatgctaacttagttagcacccctcgactttgttgtgagcgaagccaattaataatattcctgacccacttagttttaaactaggtgggctttttttgttccttaaataccctatcaagttcaccagacagcagattcccatcttcatcacaggctaccagctggcaacgacaccttggatgagtatccgtgactggaatcggtgcttgtccataggcaaatgtttgtctatcaagtggttcacaaatatcacaaacacgatcatcttcctcggttaaccacatcacatactgaacattctgttcatcatacgttctattcttaccaccgttgctattgcgtatagcttcattagctgttaacgtatgaattctggatagcatttggttcataggcgttgctaaattgtcatcaattcgaccactgctttgaggaatactgcgggtcattttattgatgtctgattttttcatgcggcgactcaaacccttgttcagggtttctttcattcgtgtcgtcatgacgtcgccatgcacccaaattcgttgagaatactcagcttggttggctactttatctggaactgttgatagtttattagggcttaaattattatagccatcgatatactgctgtttgagttcattaactgcaaatgattcactttttgctgtagcaatattcataccgcgccaatcattgcacccaacatatcacgccgagaaatagatgcttgggcaaagattgcttgcaagcgtttagacaatttatcactaggactagcgttagctagcatttcatcaattgcttggtaaaaggtagattgtaaaattaatccgaacgctgttcggacaaaaaagatcagcgttcggattaattttacaatctaccataactgctatactaaaagtgaaaagaagaggagtgatcgttttgaaattgtatcaaagccttacccaagtctaaatcaacgaacaattcgctggtcaagcaaccggctacaagctttccacgacccttgataagccgctgaactacgatccaacgattctctatcagtatttggataccgtcctgaaaccgggcagtcgccacgacgaaaacaacttgcgctacgtgactgatccgggctatatcggcgaaaactttaattaccaaagcgtcccgtttactttgcacatgaccgaattcgacgagaagatggccttcgcacgcaaactggtggccgaccttaatcgtcatttatctgtcaacatcaaaccggaagatgaaactatcgaactggtctttgttgattaaagcaaccgtgttgccctcctttcctagtcgcgatgcttctctcctgatcatttgcggctaagtacccagtcaagcatgcttagttgcaacaaaaatgaccgtctactttttggtagacggtcatttttgtagatgcaaagcacgaattcgcagctataccgctttcttcgcgacttcctttggtaacgttatgggaaatgaaattattaaatatgatccagagttaaataccattccacttcgaaaatttactccagttgaaatgaatttatttttttcgattatttctcgtatgcgtgataagagtaatcaaaccattcgttttacttttgatcaattaaaagagttaagtgcttataaacctactgcaaataaccgttttgaagatgacattcagagaacttatgaaaaaatgatgggattacattttggtagacgaagtaaaagtggattaactcgagagttttttgttttgtttacagaatttaaaattgatggagatgcagaagaaccttatgtagacgtaaaagtttatgaacgtgctttaccccttttaaacaagcttgaaagttgggttcgttatgcgttggcagagtttagagatttaaaaagtagttacgcaaaaacaatgtttcggctactaaaacagttcagaaccactggatatgcttatttttctaaagaagacttctttgaattactagatatgcccaaaagttactggaatagtccctctaacgtcgataaatttgttataaaacccattaaagaagaattaactcctttgtttagaggattaacggttagaaaaaaatatggtaaagggcgtgggaaaccagttattggctattcgtttacctggaaacccgaaaagaaagatgccaatgatttctcacaaggccaattacaagatgagcgtcaaaagctttttaatattcagcataatagtgaactaacagaacaggaaaaatggcgcgctactgataaagttaaaggattaccactaggatccactgaaaaacaagcattggctgataaacaggctgaacatgataaaaaaataagagatcaagcaagacaagaagcacttgctgaactccgaaaggggtttggaaataatgcctaaaacaattagagaacttgctgatgaattgaacgtctctaaacaaactattcaatatcattaccaaagactgccagcaaagaaccgacaaaaagataatcagggtacaaacatgattagccttacagctgaaaggattatcagagacaaggtagcaaagcctttggtagcaaagagccaacgaacaggtagcaaaaaagcgacaaagactagcaaaggaaataatgagctaattgctactctaagaaaagaggtagcagatttaaagtctcaacgtgacaaacagcttgctaccaaagaccaacaaataagtagcaaagaccgccaactagaccatctaacaaaattgatagatcagcagcaacaattacaattagcaatagtagcagaaaatcgccaattaaaagaacatatgcaaaaattaagtggctttgttgaaacgtctagatccaatcaaaaagttcaatcaactgatagtaatttgtcaactgaaaataactctattcaaaatatgaatagaaatgacaagcaagttaaaaaaaacgtacctcaatctggtaatatacaaaaagatgcacctagaaataaagtccataagaattggtggcatttttggtaatatcaagctaaattctaaatttatttttgaaattaattattaatagaaggtgctaagttgattgataagtccagaaaatcaattttaaaaatgagctcaagggaagcaaaaacttttttacttaaaccatctagttacgttaatatccaacttccaaggtattttaacttctcttctgtaattaaaaaagcagatgatttattagacagtcattcgttaatagagctttctaccagtaaaacggccctatcacaaactacagacgtaaattatactcttctaatgaataaagacggtcgctatgattggcgtccgttatcaatagttcatccagttccttatgttgatcttgttaattcaataactaataactggtcaaccataattaaccgatttagcgagtttcaaaatgataaacgaatccaatgtattagtatacctgttgaatcaattgggaaaaaaagtgacaaagcagaaacaatcttaaattggtggcaaaatttagaacaagcctcgattcgatatgctttgatatacaagtattgtattaaaactgatgttacaaactgttatggttccatttatacgcactctatttcttgggcaatttgtggaaaacaatggagtaaaaatcaccgtagtcctaaagacagtatagggaacattattgactcttcaatccaacatttacaatttgggcaaacaaatgggatcccccaaggcagtgttctctttgattttatcgctgaaattgttttaggctatgctgatcttgaattatcaaggaaactggaaaatattaaagagtgttttaaaattattcgatatcgagatgattaccgcatattttcaaattctaaagaactatcagaaaagatattgcgagagctttcagatgtattgtcagatttaaatatgcattttaattcaaaaaaaactgatataactaccgatatcattggaactgcagttaaaaaagacaagctcttttgggctgctaagaatgctgcgatttgtaacaagaacaatgacggaaaattagtttatcatttaggattacaaaaacatctattacaaatttatgatttggcaaaaagatatccaaactcgggaagtgtaactacctcgttaactactttttttaagcgtttatcatttataaccacagcacctaaagattaccagcaacttataagtatcgtggttaatattattatacggtctccaagagctgtaccagttggtactgctatactgggcaaattattggcattgattaaagactatgatgaaattacaggaatcatagataatgttattaatcaaatcgaagatattcctaacattggctttattgagatatggcttcaacgtttaaaccttgttggtaataaacaacaaagttattcagatcctttatgccgaaaaatatattcaaaaaatatcactatttggaactcaacgtggttaaaagttccttttctagaagattcaattattgatcacaagtatattaaaaaaatgaaattgacgattccacagaaggaagttgatttgtttaacgattatcctttttagcacaatacataatttaagtgcttgtatatattgcggaagggaaatatcttaatgcttgattatctcaaaataggaataccaaaagcttataaaactagaaggagtatgaaaatatgaatgttacaacgcaaaaaaaagctgcaataggattttctaattactggaagggaaagggatatgaaaaaggagaatctcagcgcttttggattggattattacagcaaatatatggtatagatgatgctaccaaatatatttcatttgaagatgaggttcaccttgacaagactagttttattgatggatatattaataagactcacgttttgattgaacaaaagggaatccataaagatttaaacaagggaatccgtcaatctgatggttctctcctgactccctttcaacaggctaaacgttattctgccaatttaccatactcgaaacgcccacggtggattgtgacgtgtaatttccaagaattcaacatatatgacatggaaaatcctattggagagccaatcaaattaatgctctcagatcttcctaaacaatattatctactcgacttcttggttgaccaaactaacgtggaaataaaaaaagaaaccaaagtatcagttaaggctggtgaattagttggtaaaatttacgatggattaaagaaacaatataagaatccagaggacgaacatagccagcgaagtattaaccagttatgtgtacgttttgtattctgtctttatgctgaagatgctggtatatttggaaagaaaggcatgtttcatgattacttaaaagacattgaaccacgtttttggcgtcgctcaatactcgatttgttcgaaacattggatactaagattactgatcgtaatccatatattgataaccaactggccaagtttccatatgtaaacggtggtttattctctgaggaagatattgaaataccaaactttacacaagagttgaaagacctaatattaaatgatgcaagtgctgactttgattggagcgatattagccccacaattttcggggcagtgtttgagtctactctaaatcctgacaccagacgtgaaggtggtatgcactatacatcaattgaaaatattcataaggttattgacccattatttttagacgatctcaaaggggaattgttgcggataaagcaatataaacaaccagcgattttgagagaaaaggccaagcaatttcaacttaaattatcaaaattaacgttctttgatccagcttgtgggtcaggtaattttttaactgaaacgtaccttagtcttaggaagcttgagaacgaagcaattaaattagctttcggtaatcaaagtatgttggatgttgggcaaaatctaatcaaagtttctatccaacaattttatgggattgagatcaatgatttcgctgtgtctgttgctaaaactgcgctatggatagctgagtcccagatgatgggagcaacaaaagaaattatatatactaatgtagattttctaccattgaagacatacactcaaatcgttgaaggcaatgcattaatactcgattggcagtcgattattccaaattatgaattaaattttataattagcaatccaccattctcaggtgcgcgtaccatgacacctactcaaaaaaaggagctagaacttgttttccataatcaacctggaattggtgacctagattatgtgtctggatggtacaaaaaagcttcttcttatatgataaacactaccataagatccgcgtttgtatcaacaaactcaatagtacaaggtcagcaggtaagtattctgtggaaacctttattttccgaaggcttagaaattagttttgcctataattcatttaagtgggatagtgaggcttccgatattgcacaagtttacgttgttattgttggatttgattatctcaaccaagcagaaaaaaggatatacagaggtacgcattttacaattgcgaataatataaacggatacttaacagatgctgacaatttgttcatcaataagagaacagtccctttatgtaacgttgccccaatgcattctggcagtaaaccaattgatggaggaaacttaatcttaactgaagttgagaaaaagcaaatcacgaaaagcaattcaaatttagaccaatatattcgtcccttcaagatggggcgagactttattcatggaaatactagatattgtctttggttggtaaatgcagatcctaaagatttgaaacgatctccacttattctcaaacgtattaaacatgttaaagaatttcgattaagaagcaagcggagtgccaccaggacaaaagcaaataccccaatgttgtttggagaaattaaagatgctaatagtgatttcatcgctttaccagaagtttcctccggtaagagaaaatatattccaattgattatctttcctctaacgtcattgctggaaacaagctttatatcattgaaggtgctagtctatatgaatttggaatcctaacatcaaatgttcatatggcttggacgcggattgttggagggaaactgaaaagtgactataattactcaaacacgcttgtttacaataactttccatggccgaatccaagtagatcacagaaagcaaagataatccatactgggaaagccatcttaaatgccaggaatttgtaccctgatagttcctttgcagatctatacgacgatttaacgatgccgcctgaacttcgcaaagcacaccaagaaaatgataaagctgtcatgcaagcttatggcatgccaattaaaggtaccacagaatctgatgctgttgccaaactatttgatatgtatgaaaagattattgcaaaaaaggataataaattaaagaattaagaaatgctttaaataacttacatgggtctatatctatcaaataaccctttcataataattttttaaagagcatttcaaagtagtgacaatactactttgaaatgctctttttgcttaaattcagaatcgaaataaaatttacccttttatttcccttgactattaatcggttaagatatacaattctaattatgttaaggttatgtactcttattaaggatatggagaatgttttttatcaagaaaggaggttttttagatgacttatttagttcttaaactatccgacaaagatcgggaaattcctatgaatactgccgacttgattaaacgagccaatggtaattggcgtatgacacctgccaagctaggtaaaacgaacaaggctgtgcttctgttccgtggacaagtgttagctgatttagatattgggcctaatgtcacctggcatcgagattcaaatagaatttcactagatactaaactatctaccccacagatatacaaaggaaaacacttagcataccgaacagcaaacccggcctcaattattaaagatgacaatctcgaaaattaccttgtttaatagacttatgttataaattataggatctagtaaatctttttgttcctaagtcaatatttggcacatgtttttctagacacttgttctgattctttcagtgttgaaccaattaatataatttgagattctgagaattaagtcctcaaagcttgagaagttcgtttgaaaaacaaattctcattttaataatgagtgaaaagcttctatttggctattatcgtaaggatatccttgcttagaatatgaatggaagatttgatgtcgtctaagcaaattctcaacatcacagctcgtatattgtgaacccatatctgaatgaaaatatgctttagcatgtcgtgaagacacagaaactgatagattggaaatatattttatggcaattaatatacaaattgtaagcgtaaaagtattagagaatcctaattggttagagtttagattttatgaggattcgtggtctaaaagtgatatatttaaaatccagtataatggtattgacatttcagggaatcattattttactgatcctcaggaagaggccctcacgggtgaattacagaaggcatatggttatgccccgtttgatgaaatgcaagtaaaaaagatattcaaagaacacactggaaatagttcgtaccatgttataagaatataaaaaggggctatagtctccaaataacccctcaaaaacattgaaagaataacccccaatatctataatgtagatattgggggctattttgtttcttttatcaataaataacatctgcttttcagaaaaattgttggacctttgtactaattgaactaatttcttgctgagataaagtgaccacaacttcgccatctgatcgttttgttggatcgacagcacggacatgttgcaataacgctgtcccgtgaattttcccgttatctatcctgataaataacggcgatttagcatacttttcttgggtacgatatttgtcagaggtactgattggcacaactagcaccgtattaaaatagcgattatagtgatcgttgcttacaactaaacacggtcgctttttcttagtttcagtgcccttagccggatctaaattaatccataaaatagcgccttgttttaatttcattaatcaaagtcttcgctttctacgtctttaccccaatcaacttctgttgtactgagatttccaaactttttttcttgttcatcaacaagttgccatagatccggtttactacgaacaatcattactttaccatttggttcaatctgccattcaattgtgtcagtagaccgaacttttaacagttcacgtactgttttaggaattgtaatctgatttttacttgtgatcttcgagttaaccttagttacattacctgcgctcacaatatcatctccttactttttccttacaaaaataataacataactgctttaatatctcaagaaaaggagaaaagactatgcaacaagttgttttacccatcaaagattccaacgttcttaaagaggttcaagatacgttactcaataactttaaagctggccgacgtaactatacgatttttcaagttggtaaagcgacgctactgcgagtgagtgacgttatgggcttaaaacaggcagatatctttaatccggaaggctccattaaacaaaatgcattcattcacgaccgaaaaacaggcaagcctaataccttgtaccttaaaccagttcaaacagagcttttattgtatcgtcaatggctgcttgatcataaactagaatctgaatggctctttccgtccattcaacacccagaacgtcatattacggaaaaacagttctataaaatcatgagcaaagtcggcgatcttttaagcattaattaccttggtacccacactatgcgcaaaactggggcttaccgcgtttatacgcaatcaaattataatattggtttggtcatgcacttattaaatcattcaagtgaagccatgactttagcttatttaggcttagatcaagccagtaccgaaactatgttagatcaaattgattttggttagttttatttggatttttagttgttgccgaaggcaacttctgagacagattttaagcataaaactcccactaaattttagtggggtgtaagtgcgcattaaactaatttcattccgtttaatgacgctaaaaaatagctaacttgatcattaaaataaaaggttttttttagtttaatgcgcacttatacgtcaactaactttgacgtgtttcgataccccaaaaattgtattagatttcgctgcgctcaaacaaatctttttaattgctttacaccgtttttctttctaaacttaatcacaatctttgaataactaactataaaaagatgcctttaatttaaacctgaaataattagctaatgttagaagtaactcagatggacgaaaagaaagtattaaagcccattgatgaaatgcttgctgatccatggcaagttgatattcaagaattatttgaagcttccgtcaatgaacctgacgagattaaaaagaacttgtatgattccttatacacttatattttgcaaaaaagacaagaagatattattaatcgaccaggtttcgtaatctagccctctaaaagctccctgagggctttttattttggctttggtacaaatatatataaatagccttaaaatcgctgagaacaaaaaataaggcccttaaaaaggggcatagcagttaaatctttatcaagttttagaaaagctaactatttgctgtcaatggtagcggacgagcgcagcgtgggagcataaggaattgacagctcttaaccagtctttacactgaaatggcgaaagccaaagtttttatagaaactttggctttcctgcctagcggcgagtgaaaaagtggtcaagctggctcagcttggacggggtacggggcgtcagcgcccgttttaatgtggcttgccacccctttttaggcaacgaacgaagtgaggcgcaaggagcgtagcgagtggagtttaatgtgagccggtttttggctcacccctttgtgttttttgtttctagattttaatctcgtacagcggtgcctcttttatacctcttttataaacctcttttaaacctcttttagacccctcttgagccttactctcccaagacatacagaagtttatcaagtaggttttgtctgtttatcaagtaggttttgtctgtttatcaagtaggttttgtctgtttatcaagtaggttttgtctgtttatcaagtaggaatataaagttgactacttgataaacataatctaaaattaatttgtaatcattaggaggtacagcactcatcaagctataggtttgaatgcttatcaatatcaacattataaagctgataggaaggcatcattaaatgctgggatatcctttggttcgcgactggtaattagattaccatcgatcacaacagctttgtcttcaatgcgtgcaccggcataatacaaatcaggttgtacagttaaatatgctgtcattgtacgaccttgcactagcccggtttgaatcattaattgtggaccgtggcaaatacttgctgttaacttattagttgccaaaaagaacttggtaaattcgacaaaccgttggtctgcacgtaattgatctggcgaaaatcctcctgggatgaacaatgcatcaaagtcttgaggactcacttcatcaatggatttatcaatgttaatctgagtaccatgcttaccttcaacagtgcctttttcaaagctgatcgttgtcactttgtgtcctgcagacttaagagcctctacaggttcagtatattcaacgtcttcgactagattagtcaccaaaactgcaactgattttgccataataaaattcctcctttttatgattattcatcgcgttttttatatttagagctagttatttgctagacccactatttcttttaagacatacctggtttcaataccactttaatgttattatctgcttttttgtcaaaaatatcgtatgcttcagcagcacgctccaaaggcattgtatgtgtaatgatatccgatgggtcgaactctcctttttcaatcatgtcatagattttcggcatcaagtggataaccggagcttgtcccattttaatattcacattacgagtgaagaaatcttggaacgggaaattcgttgctggagtcatataaaccccagttaccatcaacgtcccaaatttcttcacagcttcacttgctgtttgtattggtgagtaagaaccgctttgcggcgtaagaatatctttagttttttctttgattggcgttacaccatccattcctacacaatcaattactacctcagcaccacccttagtcatttcatataattcactaccaactttagaaacatctgaaaaattcacgatctctacgccgttcatttttttcgcatgctgcaaacgatgatcgacgttatctacggcaattacacgtttagcacctttcattttggcaaatttttgtacaaataatccgatagggccagaacccaatacgattactgtatctcctgatttcataccactatgttctacactccaatatgctgttggcagtacatctgatagaaataataccttctcatctggtagattactttcaggaacaacaaaagaagtgaaatccgcaaatgggacacgtaagtattcagcttgccctccagggtgatttccgttcattttaccaaaaccgaacaacccgccttgatcaaacattggattagggttggaattgttacattgactttccatatgattagcacagaaatgacactctccacaaccaatgttgaaagggataacgactcggtcgccttttttcactttcgttactgcagaaccaacttcttctacaatgcccataggctcatgccctaccacatagtctttttccatgaccggtttcccgttatggtataaatgcaggtcagaaccgcaaatagctgttgctgtgatgcgaacaatcatgtcggttggttcttcaatcgtaggatccgggaccgttttgacttccattttttcgtttccttgccatgttactgcgcgcataaaatctctcccttttgtaaaagcgatattttcagattctgaagacagcctatcatcttgttttatataagtcaaaagttaaaactttaaacatatcttttctaatataggtcaatcaaaataaggaaatctcataaaatacacttcttacatattctaccttagataatgagggtatttttctgtcttttggacatatctcctttcgatgaaaagacaacacaaaaaaagacttatgcatatcacataagtctaagccaagtatatttttattttttaactatttacttgtattttgttcaccttcaagcattctgcgcccttcttcaacagcagtgcttggatcttcaggtggcgtatttcttaatatttctggggcagctgttaaatcaggttcaccacctgccataatggggtcactactatagtggaatttgtttccatcacgggcagtttctccttcgagtgcttgagaggcttctccttctgagaagttgtaaagtgtatgtgtaaactccttaccttgtttttgtaagtcttgagtaccatgtggtacaactggaccgtatttttcttccaattcttcacaagcttttaagaattgaagctggtgctgcgtttcacgagccatgaggtaacttagcatatcgcgaacacctttatcctccgtttgcaggaagtttcgtgatacttgaaggcgagcctgtgattcacggacaacattgaagcgcatatcagcgagtaaattcccgcttgaaatgatgaaatttgcgctccaaggattgccgttagaatccgatagtcctgcaccaagcccattaacgaatgcatgttgagggtccataccaccaagtattgcagcggttgctgaatcactatttctcgccaattcttctatcgtatcagtaggagcgtcacgtaataggtcattaatcatggttgctaacatttccatatggcccatttcttccgtaccagtgtctaataataaatctttatatttttcattgccaacagtgttccaaccttgaagcgtataggccaacattcctgtagtttctccccattgcccccctaaaatctcctgtaagcgtcgtgcgataataggattactcttctcaggctttgcatgatattgtaattttgattttcttatgtacatgtgacagtcctcctaatgtattataatgccatacgtcgcattaatttcttctaaataaggattacataggcaatgtaacatgcatatattcatatttcaaatgaaatggtttcaaaaaatattacaaaagaggcctagattgacttgattggggacgtcttttataactgatatattcatttggtatttttctatcgctccataacttaaaactttaggactaatcggttatggccatattgagcaaaaagttgctaaaataggacacgctttttctataatcatcgtcttaaaaaggttcctgaatcatggattcagcaggtttcatttgatgaactattaaggtaatctgatgtgcttagtctgcatgtgatccaaacaccagaaacaattgatttaattaataatgatacaattgccaaaatgaaaaatggggttattatattgaatacggcccgaggcaaattggttagtgaagcggacatcaggaatgccttgaatgaaggcaaaatttatgcctacgccactgatgttgttaaagggagcccattgctagtgatagcccattattacaggccaaaaattgttatattaccccacatattgcttgggcaccatatgagacaagagatcggttgttgcatatgactgttgataatataaaagcatatttatcaggagatctgaaaaacgttatcaattaatggcaatggtccgtgaattcttttgcttacattgaagtaaaattgtctaaaataaagcaatgagaaaaaacagagccagcaaataaagtgttaagaaaaatacggagagctagaactttatagcttctccgtatttttaaaggacacattgcgaatttcttgtagtgggataaaccgatcagcgtcaatcacaatatcattggcattgtagccatggatcaaggtggtgatatctggcaaatgacggttgttttggtcaaccgtttttaattgaatggtcactggttgctgacgctgatatgcgtccgccaatacctcggtaattactgctaaggattgttgcggtcttggaacgtatatttcattcaactgctggttctgttggtttaaagcggcagtatgatcagataaatagaaaccctgccatttcatcatgccccggtcatgataatcgtgttcaaaaaaatgcttaaccgtgcctaaatcaaagtcttggttattcaaggggcacccgctttcgttgaatcagcttttgacttgccggccaccgttctcctgtaaagccgacaaattcgatcgttagctttatatcttgtcgtaatgcttttaacagcttttctaaatcagctaaatcatagtgtgctaatttatgtaagggaacggattgcaagcgctcattagcccgttgactgttaaaaaacagattataggtctgatcgtaggtatcattagtcaacattaaccaatagcgggttttgggacgccgcttaaacaatagggttaaccgccccttaataatctcgatatcgctattcatagctattgcctccattatgtccgcccactagtgaagcccgcttgatagcggtgcctccctttaataaactggtcgcgtaaactagtttggtgaacccaaattgccggtgaatttcatcaatcacctggtttaaccggctatggcgaatttggttgcgcggggtttcaaataaattaagttgttggccggagttggcacttagtttactgctataaacaccaatattccggacagcttgaccgtcccaattctgacggaataaccacaataattgttgcgtcaaaacttgattgtcattagttggttcaatttttaaagcctggtgaaagccaccgcgaccatctgcttcagctgcggcataggaaaacccaatgcttagcgatagacaccccgccagtttatggtggtgccgaagccgcgccgccacctgttccccaatttctttaatgacggtttcaatttcgacttggttaaaataatctcgtggcaatacttgcgaattacccaggctagctgctttaaccttagttggttccgtgaattgtgcgcgatcaattccccaggccgtagcaaataattggctaccaatgacccccagctgctgtttgagcaaataagggttagtgtgggctagctcatacatgttgtgaatttgaaggcggttcaaacgtttggccatgcgggggccaataccccaaacgtccgttaactcatcaattgaccaaatcttatccggcacagtttcgtaatggatttcaccgatcaattcatgattatgtttagcgtaaaggtctaaggctaatttagcttgcaccggattgtcaccaattcccacggtggtatacaaacctagcttttgccgaactgtcttttgaatcaagcgcgccacttcgcgaacggaattgccaaacagccgccaagtatgggtcatatcaagaatgctttcatcaatcgaatacggccaaacctctttttcagtggtaaattgatgaaagatctgattgatctgcaaattacgttgaatataaaggttcatgcgcggtggcacgacccacaacctggggtcattgggtaagtcacgtttacgggagacattggctttaagatgaaataagtgcttagcttcgggtgacgtggctaaaataagcccaccattggtattttcagcttcactaaggaccactaatgggacttttaagggattaagccctcgggcaacggcttcgcaactagcataaaaggacttgttatcgattaagaagaacacgccatgcggttcatcatcaaaaaacatttagatcacttccgttagcttttacctgtattgtagcacaaaaagcaaacgtgcgttccccctgaagctgctagaaagctgattaaaaatagtcgaaagtcagttataatcatgctataatgtagacagaaaaaggaagtcccgctggaacaggacttcccgtacaagccgctttaaaggcggtggcctagattacaaaactacattgtcgccctgtaaccgaccaaagttacgcagggcggcttttttatttgttccttttgtcgatgtatgttagcaacgctaaaataaacattgcaaacagcagcatcaacgagagtgtctggaagacgctcattgactgtgaaaccttcctgaagattattccatgttcccatgggcctcacctcgcaagggaaaagacagccaccgcccttaaaacttcttgcgaagtttattatacaaagaaactcgcaacaacaccaagcagatcgaagtactagattttgtttaacgtagtaacaaaacaaaggagaggctaccaatgtgtgcacctaatttattgcagtttgtacctaatgattatattgcaaataattatttaaaaactaatttttatttaaaagatgttctatgctatagaaaagttgaagaaaagattactggcactatgccctccaacctaaaatttgacgattcagagggaaaagctaaaaattggagtttgctaaggcattgctgttttatttcctgttttacaatgctaagtactaatgattttaaagatggtattttggatcttggcttcgcagaaaaactaaaaaaaggaaatgtcgataatgctggtaatagggttgaaagaccgtttataaccattagctcagaaaacacccaaaagttactgattgatttaagtaatcaagttaatgattatttgaaagacaataatctgaaggggtctggattgttttcacgtgccgtgaggtatcttgatgaagatgattataaaaaagaagagctctacgaggaaaataatataactaatataaatggggttttcatcaataatgacacaaaaatgattagtcgctcctcaagaaatgattctctgttaaagaatatattacaatttctctatctatttaaacccatttatttcaaggatcaacacgaatatagactgggattgaccttagatgatcccatagatgtaaacgaactatttattcctatccatgacttaagaaagtatgttaaagtacaccccttccaagacattaataatctacagctggaagatatataagttcttgaggtatatttaaatttcattaatgaaattttctggatttaatacaacgatttttcaaaacggctaatagggtatatggtatcggactatcttagcttcttaatattttagatactcattagaattattcaaaatatgtattaattaaagagagtagcattgaaaaaccaggaagaaaatgtattgaaaacatattaattgggggatctaattatggaattatattctgaaagacatgggaaaagggacctaaaacagcacacatattgtataaacgaaaatatgtactctctattacttagttgctgtacaaaatataaaaagaaccttaccaaaatttttcaactaccatgtcataattcatttgtagatgaagactacattaagtttaatgaaaaaattttttcgcaaaggattaatagtaaaataccatcactttttcgaaatgaatcaggagcaattgctgctcctaaatctggtgataattatgatcagtacgctttactagacttaattgaattctttgggaaaaatattaaagatgtgcgcgaagcatggaacaatgaaaattatagaaattacaaaaatatttatatatatgattcctcaaaagtatttaatgagtttaaaaattcaattaatgaattattttcggaagctggattactgtatgagttaaacgatgaaaagattatcgaaagactcgttgatgatgatgttctaacaccggaaatagaaactagttttgaatctctaacagataaacaactacatgatcttttagagagtgctattgacttctatagaactccaaataattcagctcgtcaagaatcactagaaaaattgtggggggcattggagagactcaaaacatactatgaatcactaaacaagaaagaatcagtccaaaaaatagtgaagaatatggctcatgaagacgaagacttctataaaatgtttgatgacgaatttaaattgctgacgaaaattggaaacaattacaatattagacatcatgaaactaatcaaaaagatttaccagataaaaattattacgattatttattcaataggtgcctatcattgattgctttatctgttaagtatctattaaaataactgtagttctacttagcaaatggtagattgcaaatttaatccgaatttttggacaaatttgtcagcataacctgatacggtgtttgccagtcgagtattttaagcggtcgctggttaatttggagtaatgtcgtcgttaaatcttgagcactaatgtgctcaaaacgagtccctttatgataaaaataacgtaaattccgattaaagagttcattactaccacgttcagctggagtataagcatggcagtaataggtcttaataccatattgtgattcaagtgatactagaccgctaaactcagtgccacaactatgcaccgggccattaaaagttgctagaaacttatttagggcttcattaacagttactgctgtccgtttttttaatcggtaggcccaaaggaaacgtgatttgcgatcgattaaggttaataaaactgccttaatatgcccacgggggccaacaattgtatctaattcagaatcaccgatgcgattacgtcgattaaccacgatgggtcgctgttcaattgaccgtcctaatgattgattatatttagaacgttggtcaaggttacgccgttggcgcacgccatgttcaggcaaatcatttaaagaaaactcaattttcccttgatttaaccaattataaattgatttagtcgctagtttaaattcgtgagctatcatttctggtgaccaacttagccgtaaatggtttaaaattatttgccttaatttgtcattcaatttagtctttcggccacatcgtgaccgcttgtattcgacatctgtttgggccacttcggcctggtaaggttcacatcgagctaattcataagaaattgtggcaggtgatcgttttaggcgatcgctcatttggatattggacagccctagttcacaaaaggtttcgattttaattcgttcagaataggttatactagacaaaagatcagctcctaaaagatgggtttgtggtaaacaccattttaagggaagctgatcttttttgtccgaacagcgtcggattaattttacaatctaccattataatattaaaccaacggtatatatgtaacaatagagtgtaccctattgtgttacaattagtttattgaaatctcggtatttatgtatgacacaatagagttgtcacataaatactttaaaaagggagtcaaaaaattgaaaataggatatgcacgagtgtctaccactgatcagaatttagactgaccccttggaagcatcatttatttaagttagatacatattatatgtacgaagacatttcatttacacaagattcttgacgctacctatttttaattatattcttgtaaaataagagtgacatgcctaattctgcaaaataaagcacttttttgtaaatagtcagggagatatcatgaatcagtcaacttttcagctacttggtaatgttgcttcagcagatttctacctttgtgaaggcagtgatattactttaatatctgataataatgcctacaatatgaaagctttagcccaagaagcgcttaaactgcgtgttcctaattctttgaccattattgatttaaacaacttctacgttggtatgatccctagtgatcataatcagatattgaccatgatttctcatattaacaccaccaatatcccattcaattatcaggaaatcactaattttatcgagtctagaatttttggtgttggaaagtatttccattccaaaagtactaggccctaatttaaaaagccattgataatggatcaaaaaaggccactagggtataccctagtgccttttttatttctgcgctatactaggaattacaaatgttcattagaactgtccaaaaagagaattggaaatggctaaaatcggttatgcgcgtgtgagttccaaggagcaacatttagatcgacagttagcggctttaaaagacgttgataaattatttacggataaattaagtggggctaacactaatcggccagaactgcaaagaatgctggcctatattcgtgagggtgatattgtcatggtcactgaattagatcgcttaggcagaaacaaccaggatttaactaagatcatgaacaccattcagaataaaggggccaccctagatgtgttaaatttgccgtccatgacaggaatcgctgacccgaatttacgtcaactcatgactaacctcatcattgaactgtataagtatcaggctgaaagcgaacgtaagcgaatcatcgagcgtcagcaacaagggattgccctcgccaaacagcagggtaaatatcatggccgcaaaccccaatacacccaagacgatccccgcttgcaacatgcttttaagctttatcgagctggcatgagtgacattgatgtgtcccgaaatacaggtattaaacggacgacctttattcgataacgtgtgaaatacggtattaaaagaaaataggccccccttttggttagcacatgttaactgaaagggtccctgttttctttacttaataagtctaattaaattagtaagtttactcaggccttttctgggtgtaaataaatagttaattgagattccagcaatgacaatgatggctactacgaacaaagccaaataccaagttacttgaatccccaggggaagattaggcgcagttaaattaatcaaggttgatcctatagccgtaccatttgcaatggcaatattttgaatcattcgttgtagtgaaccgattgtgccttgattgctggtggaacccgattgcatgatagtggaaatattagctggctgaaagtagccaccaccgattccgaataagaataggcaaccggttacgataactggcagccattgaacaccaactaacagcaagccaacgaaagctagcgcaataatcataatccaggtgatcggttcagccggacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccatataacaaaggaaaaaacagtattaataattattataatggagaattgactatcaactttgattcacaaacggtcaaagtaaaccaaaatgaaatccatttaacaccaaccgaatataaggttttgattattcttgctgaaaacacttcccgcgtgttgacacatcgctatctgttgaaagaggtctggggggcagaatcggttgaagatacatcttctcttcgagtgaccattgcaactttgcgaaaaaagattgaagttaacactcagaatcagtatattaaaacacatattggagtcggttatcagatggttcaactagatagttaagaatagaatgcccataatttatggtttcaatcagtatatcgtaaattatgagcttctttaaagtgatttcattatgatgtatatggcatagttgcttttcttcgtgtttaggcgtactattttgcagtgctatatttcaataattagcgttgggggcaagcaaatatgaataagcaactagaacgtgtttcttttgcgggggcacttgttactttaggaattgtgtacggtgatattggcacttcaccattgtatgttatgaatgcattgattggtgacgccggtaaaatgggaaatatttctcccaattacgtgattggatcgatctcgttgattttttggacattaatgatcattacaacgttgaagtatgttgtcattgcaatgcaagccgataataagcgtgagggcggaatttttgctttatatgcattggttcgaaaaaattcaaaatggttaatttggccagccttgattggtggggcggccattttggccgatggaacattaactcctgcagtaactgtgacttcagccattgagggattaaaaaaacaacaccttggccctgtggtgtttagtaattctcaacataacgtcttgattatcacaacagttgttctactcgtattatttatgattcaacgttttggaacaggtgtgattgggaaatcctttggaccagtgatgattttatggtttggctttttggctgtctttggaatcgttaatctaatcaattatccaatgatattgaaggctatttctccttattatgcaattaggatactattcagtccagttaacaaagtgggaatctttatacttggaagtatctttttggcaaccacaggagcagaggctttatattccgatatgggtcacgttggcaagcagaatatttatgtaacatggccactagtatatagtaccctatttttaaattacttaggtcagggtgcttggataattagacatgcaggtgatactgcttacaggaacttatcgaacttaaatcctttttatgaaatgctccccggaacttggcgcctagttggcattttgctagccacactcgctgcaattattgcctctcaagcgttgattacgggttcttacactttagtcgatgaagcaattggcttaaaatttttacctagaatggttattagacatccaagtaatataaaaaatcaaatttatattgcaactgttaactggatactatgtataataacaattggtgtagtctggttctttggtagttcacaaaaaatggaggccgcgtatggtttagcaatcactattaccatgcttatgactactgtgcttttgcatgaattcttaaagaaacacctggctaagggaacagcacttataattgccttgttttttggttttattgagttaatctttctaatttcaagtttggttaagtttattcatggcggttatgttacgttaacaatcatgttgggcattctttatattatgtggctttggtactttggaaataaacgaagagaacattatgagaaagaaagcgagtatgtttcacttcttgactatcgtgatcaactctctaaattaagcgcagacaatacagtacctttgttcacgactaacttagtgtatatgactaaaattaagggtgattaccaaattaagcgtagtaccatgtattctattctcgacagacaacctaaaagagctaaagtttattggtttgttacagtcaatgaaaccaatgcaccttatgaaagtaattatacagttgatttacttgagacgcataatgttgttagcgttcaattttacttagggtttaggaaatctcaatccgttagcgtctatttacatcaagttgtaaatcatctagtggaacaaggtattttagaaccacaaatacccacgtattcaacagagcgacaacggaaagtcggcgactttaagtttgttattataaaggaacaaccagcagatttaattgtcaatgataagttaagctcgttagatagaagattgattggcgggcgcatctatttgcagaaaattacggcctcacctatttcatggtatggtttggagtttagcaatgtcatagaagaaagttctccgttatttattactcaagatcaggatcaatacttaatccaaaggaaaatttatcatcgaggcagattaagtaagactgaaaaatgagtatgcagtagtttaagtgcaacaactaagctagaaaaattatatttagttttaattaatggtctgatctcagtaaagtactgagatcagaccatttttattcatcgaaatgcgtttagtgttttactataacacgtatttagaagcaacttgtttagatctctcggtttgtaaaattaagttaatactaaaaaagccatttgtagtcggctgttgagtgttaaaatcaaaagcctaccacaaaaggtggatgtaagctgattcctgagacaacttttaagagagggtataatgaataaatcgtctctcaaaaggaaggaatttttacctgccaactcgttacgacaaagaattcaaacaaaacattatcaacctatataagcaaggcgaatcagctgcccaactggccagagaatatggcattggctattcaaccgttttgttctttgaaaactgaataatatctataattttctaattttaattgttaatcataattaaaccgagagaaaaccgcgtaatttaaagagttataaaacaagattagttcaaagattaatcgctaaactcaattaatcactttaccgtaggtaaagataggttaagttaggaagggcgcatggtgaatgccttggtactaggagccgatgaaggacgggactaacaccgatatgcctcggggagctgtaagtaagctttgatccggggatttccgaatggggcaacccaatagttttaatcgactattatccgcatctgaatacataggatgtgtgaaggtaaacgtggggaactgaaacatctcagtacccgcaggaacagaaagaaaattcgattccctgagtagcggcgagcgaaacgggaagagcccaaaccaggaagcttgcttcctggggttgtaggactgaacatttgagttaccaaagaacttgatagctgaagaatctgggaagattcgccagagagggtgatagccccgtaagttaaatcaagttctctcagttcaggatcctgagtacggcggagcacgtgaaattccgtcggaatccgggaggaccatctcccaaggctaaatactacctagtgaccgatagtgaaccagtaccgtgagggaaaggtgaaaagcaccccggaaggggagtgaaatagttcctgaaaccatgtgcctacaagaagtcagagcccgttaatgggtgatggcgtgccttttgtagaatgaaccggcgagttacgttcgtatgccaggttaagttgaagagacggagccgaagcgaaagcgagtctgaatagggcgatataagtatgcggatgtagacccgaaaccaagtgacctacccatgtccaggttgaaggtgcagtaaaatgcactggaggaccgaactcgtgtacgttgaaaagtgctgagatgaggtgtgggtagcggtgaaattccaaacgaacttggagatagctggttctctccgaaatagctttagggctagcctcggaattaggatcgtggaggtagagccactgtttggactaggggcccatcaagggttaccgaattcagataaactccgaatgccatcgatttatgtccgggagtcagacggtgagtgataagatccatcgtcgaaaggggaacagcccagaccaccagttaaggtccctaaatatatgttaagtggaaaaggatgtggagttgcatagacaactaggatgttggctcagaagcagccaccatttaaagagtgcgtaatagctcactagtcgagtgattctgcgccgaaaatgtaccggggcttaaacatattaccgagactgtggatgccaccattaggtggcgtgataggagagcgttctaagggcaatgaaggcagaccgtgaggactgttggagcgcttagaagtgagaatgccggtatgagtagcgaaagataggtgagaatcctatccaccgtatgactaaggtttcctggggaaggctcgtcctcccagggttagtcgggacctaagccgaggccgagaggcgtaggcgatggataacaggttgatattcctgtactagttaaacttgtttgaacaatggagggacgcagtaggctaaggaaagcacccagctggaaaagggtgtccaagcagtaagtctgaagtagagtcaaatgctttacttcttaaggacaagctgtgatggggagcgaaatttaagtagcgaagttcctgacgtcacactgccgagaaaagcttctagttagagtttagctacccgtaccgcaaaccgacacaggtagtcgaggagagtatcctaaggtgagcgagagaactctcgttaaggaactcggcaaaatgaccccgtaacttcgggagaaggggtgctgatcgcaagatcagccgcagtgaaaaggcccaggcgactgtttatcaaaaacacaggtttctgcaaaatcgtaagatgacgtataggggctgacgcctgcccggtgctggaaggttaagggaatgagttagcgtaagcgaagctctgaactgaagccccagtaaacggcggccgtaactataacggtcctaaggtagcgaaattccttgtcgggtaagttccgacccgcacgaaaggcgtaacgatctgggcactgtctcaacgagagactcggtgaaattataatacccgtgaagatgcgggttacccgcgacaggacggaaagaccccatggagctttactgtaacttgatattgagtgtttgtacagcttgtacaggataggtaggagccgtagaatccggaacgctagtttcggaggaggcaatggtgggatactaccctcgttgtatgaaccctctaacccgcgccactaatcgtggcgggagacagtgtctggtgggcagtttgactggggcggtcgcctcctaaagagtaacggaggcgcccaaaggttccctcagaatggttggaaatcattcgtagagtgtaaaggcagaagggagcttgactgcgagacagacaggtcgagcagggacgaaagtcgggcttagtgatccggtggtaccgtatggaagggccatcgctcaacggataaaagctaccctggggataacaggcttatctcccccaagagttcacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggcgctgtccttagtacgagaggaccgggatggacacaccgctggtgtaccagttgttccgccaggagcatcgctgggtagctatgtgtggatgagataaacgctgaaagcatctaagtgtgaaactcacctcgagattagatttcccattgccttcgggcaagtaagacccctgaaagatgatcaggtagataggctagaagtggaagtgtagtgatacatggagcggactagtactaatcggtcgaggacttaaccaagtagaagtggttgaatctcgaaggaaaaaatagatattgttcagttttgagagaacaaaagttttctcaagtgataacgtaagttagcacagagtgtggtgacgatagtgagaaggatatacctgttcccatgtcgaacacagaagtcaagcttcttaacgccgagagtagttgggggatcgccccctgcgagggtaggacgttgccatgcggtcaccatccgtggggcaattaaaaacggcaagtttaatatttatgatatgcggacaaacaagcttattaagagcctcgacgctggtacttgggagaacttggcctattcgatggatgccaactccattaacaatgttgatggctaccttagctacagtggttggtaccgaccaattggaacaagccaagatggtaagacatggtacaagaccggggctggtgactggcggccaatcttgatgtatgcatggccaaataaggatgttcaggcacaattcattgagtattttgttaatcatggttatgagaatgctaattatggattaacaaaggtatcggtagcaaatcttaataaggacacagatgcaacagttcttaacacggcagcacaaaatcttcgttacgtaattgaacaaagtattgctactaataagggaacgggtaagttagcaaatgacactaatggttttgcagctactgttcctgaactatcggcttcatctgaattatcattacagagcatgccaaattataagcctgataaaagcggaactgtagatagcgatcaagtaatcttcgttaatgacgctgatagtaagtatcgcttaatgaaccgtacgatcaataaccaaactggtaatgataatagcgataacagtcctgagttattggttggaaatgatattgataactctaatccggtggtacaagctgagaaccttaactgggaatacttcttgttaaattatggtaagctgatgggttataaccaggatggtaattttgacggtttccggattgatgctgctgataatattgatgctgatgtgctcgaccagatgggacaattaatgaatgatatgtaccatatgaagggtaacccgcaaaatgctaataatcacttaagctataacgaaggataccattcaggtgctgcccagatgttgaacaagaagggtaatccacaattgtacatggattctggagaattctatactttagagcatgtcctcggacgtgctaacaatcgtgataatattagtgatttggttactaatagtattgttaaccggcaaaatgacgttacggaaaatgaagctactccaaactggtcatttgtcactaaccatgatcaacgcaagaacttgattaatagtttaattattaaagaccatcctggcatggcttacattatgggatcagcatataaagcagaatatgctaaccaagcttggcaagagttttatgctgatcaaaagaagaccgataagcagtatgctcagtataacgttccagcacaatatgcaattcttctaagcaataaagatactgtaccgcagatttactatggtgatctttacaacgaaactgcacaatatatgcaggaaaagtcgatctactatgatgcaattacgacgttaatgaaggcacggaaacaatttgttagcggcggacaaacaatgaccaagcttagcgataacttaattgcaagcgttcgttatggtaagggcgttgctaatgctaatagtgagggtactgatagtttgagtcgaacgagtggaatggcagttatcgttggtaacaatccacaaatggcagagcaaacaatttctattaatatgggtcgtgcccatgctaatgagcagtatcgtaacttgcttgacacaacggataatggtttaacatataatgctgatggtgctgaaaatccagagaccttaacaactgatgataatggtattttgaaggttactgttaagggatacagtaatccttatgtaagtggatatcttggtgtgtgggttccagttgtttctggaaatcaggatgttactactaatgccgccactgtttcagcagatagtaataagatcttcgaatctaatgctgcacttgattctcatatgatctatgaagactttagtttgtatcaacctgaaccaacaagtacagagaatcatgcatataatattattgcccaaaacgctgagctatttaacaacctgggaatcactgacttctggatggcccctgcttacacaccgtttggtatgagtcgctataacgaaggttattctatgactgatcgctataacctagggactaatgctaatccaaccaagtatggaagtggtgaagaattagcaaacgcgattaccgctttgcatagcgctggcttaaaggttcaggaagatattgttatgaaccagatgattggcttttccggtcaagaagcagtaacggttaccagaactaacgatcgtggaaggcagatttacgtcaatggtaagacatatgctaatcaaatctactttgcatacacaaccggtggtggaaacggacaggaaacttatggtggtaagtatctgtcagagttacagtccaagtatcctgacttgttcaccacaagggccatttctaccggcgtagctcctgatccaactactcatattactaagtggtctgctaaatacgaaaacggtacatcacttcaaaatattggaattggtttagctgtgaaattacctaatggcgattacgcttacctgaatggtggtaataacgataagtttaagacgacccttccagaacagatgggatcgattggttactatgtttaacaggaattaaaaaattaggctttcctaagctgattacgacaatattacactacggaacctaaaagagtgaaaaactgcaatttatgggatttcttcccggtaaattgcagtttttttgtctgttttgttacattttgtggttagtaaggacaacttatcgaattcgtgactatgccagggagattaatgaattatagaaggtgtattgcagttattaatttcgttgggagaaacgaatgcaaagcgaaaaagttaaaataactaaaaaagagattattgaagcaattgaaacaaaaaaggaatatattttcgagttaggacatgttcaagttaaggcggttactagtaataaaccagttttcaaagtagaagggtcagagcaattaggcaaatttttatctgccgagataggaaattatagtcaagaaatttttaaagtcttgtacctaaatattaaaaatgaggtaatttataaacaagaattatttgcgggcataatttccactatggctgtagaaccttttcaaattattcaaacagcagtattagttaatactcccaggataataattgcacacaatcacccttcaggtcgttttgatgaaccaagtcaaaatgatataacttttactcaaaatctaaataaaattttaaaaatggtcggaattgaactgattgatagcattattgtttcgccgaatagttattattcactggcagataataggttattatccgaataatttataaaaaggcttgattataagcgaaagccccaggaagagtagatataataacctattcttcctggggctcttttaacgagatactatatgactttaatttcaatctttctacctaaagcgttcataattgaaaaaaacttatcaaaagtgacgttttcaccatgttcaatatttgcgattgttttttgagaagtgcctgcaagttgagataattcagcctgagttaaaccagcatcagttcttgcattatataaagcaatagcagcttccagcttgccacgttctgtatcaagtccctttttaaattcagggtctttacttttttctttgattaagtcgttaattttcattgaaccattcctccctaatttgtttagcatgtttgatttctctttttggtgttgtttgtgtcttctttgtgaaaccgtgagtaattacgtaccgcccattaactacatggaaatacagaactctttgaatattcgaactaactttactacgaagttcaaataaattatcatctaactttttaatccatttcattttttgtgcagtcagtaaacccttttcttgtgttaattcgattacttctagaagcttctgttggtctttaatcggtaattcttcgataaattctaggaactcatcatgaccatttttccttttatatgactcaaattcaatattttccatgagttaattataacatataatacttattttatatactatacgttattttttctcatttgtttatttttttgcttatgaggcaaagcgttgcgtgcctcaaaatattttttcacttttaaacgtgaacatggaaacatgtcgaagttaattaagcaacttttagaacgccttagccagtggtggcttaggcgtttttacttgcactaaaagtttttgggaacgcagtccagaaaaagttttagtggagttgctgaattagctagtgaactgggtagtgaagggcaatttatgcccgaggccatgaaagggaaactttgagctgatttgggaaccaaatcggcttaaacccttgaatcccagtttgttaacggtcgatatgttgaacaatgcggagcgtcaaaagtaaaaaacagataagtatacatcaatacaaaatgaaacgttcttagaatgcgtttctcaaacataagattagcagtttttcttttatttattattcaatagataaattatataaaaaaggaggtaattttttggctataaaaagtattggatcgggagtcaatcgtagaaaacagaattatgctccctggtgggcaagaaatattaaattgatgaacgtttttcttggttgtgtattaattatgataatgcttgcatttacctatgtttctggtatgtcatatgcactttttatggcaggcagacaatggtttattaatcttatgaagaatgaacaaatatggacagaacctaaacaacttggattaacgtggcatcatgtctttgattggcactatgttttaccaactatagaatgccataatcctatttttccatatgctgtaaattttggaagcctaaccgttgtttatatgtggtggcgaatcatttatacatatcaaatttataacggctatgaaaaaggtgcagaaagttttactactgaagagcagttaaaaaaggaatatgcgcagattcctgatagaaaaaaaggatttgaagattacggtggaataccattagttcactttaataactcagttggtagtctaattcaaacaataacatatagtcctttttttgaaattaaaatttttaataggaaaatattcaggtcgttaagagcaatgttaattaaattctatgacaaattcccaggcggaacttacggaatagatcaaactactgtgaatacgatgatttatggaattactaggtcaggtaaaggccaaacaatcattttacctttaattgatattatttctagagcatttaaaaagtgttcgatgtttgttaatgatccaaagtggattgaagtcaatatttgagacagcgcccattgttttcgacatttgttgcatgaaaatcctcctcaagtgtatggataagacctataccatttttcgatactactttagattaattctaaattatgtttatggcaatcctaaaaagtgttaaaattcttgtcagagggggaaatcacgatgaaaacctatacggactatttctttgatgagccagcgtttgatctccacgatgtagggtacgtgccgcttgaggtcagtgatgcgcctgagaagcccttaaatgtgccgccgttgttgaaaccggataaagagacggcgaccgacgtttattacacggtgacagcagaggctgggggaacgcaactgttacctggggcgaagaccaagacgtggggctataataccagtctgttaggtcagacgattgtgtatcgccgtggtcagcatacgcatgtgacactgaaaaacaccctgcctgagttgaccacttttcattggcatggggctaatgtcagtggcccttatgttgatggcggatgccatgcgccggtttatccgggtgaaagtaagcatatcgacttcacattggaacaaccggcgacgactttgtggctgcacgcgcatccgtgcccatccacagccgagcaggtttggcatggtttggctgccatggtgattgtcaaagacgaccatgaagccagcctgccattgccaaggaactatggcgttgacgatattccggtcattttgcaagaccggcgttttcatgagaacaaccagtgggactaccgggctgattatgatcctgacggtgttgctgggccaactgcaatgattaacggtacaatcaatccctattttgatgtcaccacgtaaaaggtccggttgcgttttctgaatggtgctaatcgccgtgaatggcggttgcatttttccgatgacctgccatttacgcaaattggcggggatggctcactgttaccggagccggtcaaatttacccatttgatgctgacttgtgctgagcgtgccgaagtgattgttgattttggccaataccatgaaggcgacgaggtcaccttatatacggatgatgtgccattgctaaagttccgcattcatgcgtttaaaccggatcagactaccttgcctgataagttgttcgatgtgaaggcaccagtggttgacccggctttgccagttcgccacgttgtgatgcaggggatggacgaaggtgttgcgattgatggtaaaaagtttgccatgcagcggattgatgccacgcaaccaattggcaaagcccagtactgggatgttaccaatagcaatgatgcgcctggaatggttcatccattccatgtgcatggaacccaattcttagtcttgtcgcggaatgggcatgcgccgtatccaaatgaacatggtttcaaagatacaattggcgtgaatcctggtgaaacggttcggctgctggttcgctttgatttgccaggggtttatatgtatcactgccatatcattgagcacgaagatggcggcatgatggcacagattgaaacattcgatccagccaagccaaagcaaaaatataaattgatggatatggatacgttaatgatggccttggctaaagaacggggcgtcaaaccatctgagatttggatgggcggtatgcagtcttatgaaaaaatgggaatgaaaatgtaaacgtcccacaatactaatatagaaaaagatgattttaatatgcactctccaacgatcaaacatcgcggggcttttgtcgccacgttactgacaggtaccttttcgatgtcaatttctcagtcttctttaagcaccgcttatcctgcttttatgaaagcttttggtttaggagcggatacagttgcttggctgacaaccggctttatgttggtgatgaccttgatgatttcggttagcccatggctgttgcataatgttactttccaacggcttttccaagcgattgaactcatttttgccattgggacaggcttatgtatctgggcaccgagttttaccgtgctcatgattggccggttgcttgaagcgattgcggtcgggattattttcccgagtttccagaccgtgttgctgacgattacgccgcatagtgagcgtggtcgggtgatgggcacggcgggattggtcatgggctcagccttggcagtcggtccgattatttccggtgttttgctgacatggttcccctggcaggctttattcttgttcttcttggtcgtttcgctgcttgtgctggccgtttcaacggtgaccattgcgtctgtcatgccattgcaaccgacgcaactggactgggtgtccttccttttatccgcaagttttccaattctactttatgccttgggtgctttgtcgaaaaaaggcttaactgttggcgtggttggtttgttgattttaggcgttctggcagctggtattttcgttgttcggcaattgaatcgccaaccaccaatgttgcaaatgcgagtttttgccactggtatgtttactaaagcggtgtttctgaccggaatttcatacgtctatcgaattcgtgactatgctaaatcaattaatgaactatagcaggtttaatgtgaaatgtgcttgtagttcgccttacagacgtgattttatgatatttgtaagaagaaattaatttatataaaaagaacttactcaaattaagctatgtttatacttttgcgtacggtgtgtacattgtatgcgcggtatacttagtatacaaatgataagtatatacaattgcctgttctcatactgagttatttatttataataactatatttatattttgcatacaatgtgtacattgtatgcacggtatacttagtatacaagtgataagtatatagaaacacctactctcaagctgcattattttattataataactatatttatttttttgaaaataatgtatacattgttttcatggtacgcatcgtatacaaatgataagtatagtaaaaagaacttactcataattagagtaagttctttttcgtatgaaatatatctaaattattttgtacacttcgtacgctttgtatacagcgtgtacattgtatacaaatgaaatctttaataaatgaaatctttaatcaagtcttttgaggtttaaatcatacataccttgaaatacatctttttgtcgatcaggtaggccttctttaatgtagtaatcagctaacgttgaaataatatcatcgattgatgccttatctgctcgttccaattcggtcataaaaggttgtagtgttctacattttagaatcgtagtttccgagagacgctgagtttgagttttttttgatttcctttttgcaggtttaactgtgttagaatcttttttttcagctaactctatatctggtgaagtaaattttggatttgtaaaatcatttccatcagtaaatttaacctctttttcttccaatgtactttttttattagttgttaagatcggatcaatagacatattgcgcccccctattctactttctcaaattcttgttgatgttgatctaactcggttagaacatttttaaatacagtgtgagcttttaaatcccattgatctggtgttttactaatatttttctttaaatgaattccttctacatcgtacacttttaggcgttcttgatatttaacaattgtttctaatacattattgccataagatttttttgcatcattaagtatcttgtcatcgactcgtccacctggacgaagcatgcaaggaacgatacccaatacctgaagttgcttgttataagtgttaataaggtactgcatataatcaatgtatgtttgtgctccatctaaagatagttcctgagtttgtaaaacaataatacaataatctgctgccatcatagcattgtctgaaaaatcagaaattgttggtggcacgtcaatataaatagcatcgtacttttcttttaaaggtttaagtagttcgtttaagtaattaatttgtgcttcatcgttatttggaaacttagacattagcaatttaggtaagttcttaaattgtgtaacactagaaattaaatcaagattttccataataggagttacttgtgaagttagatcaccttctataaaacctttataaatatttttgtcgattatttttatgccacctgtcttggctaaaatactcgatgcgttagcctgaggatcaagatcgattactaaagttttacgatttttgtatacggctgatgtataagcaagcatagttaacgtttttgttttacccacgcctcctttaaaattcccaacaacatatacagtacagtctcttgtacctgatacagttccgtcggcgccaaaatataattggtcatactcaaggtttttatttgtttctgtcataagattacctcttatttttatttgataaatatattatagtatacaattacaaacattgcaattgtatacgggattttatttttatgtttatttgtatacttcgtgtactttgtatacattgtatacaaatgctatttattaaaaataaatacaaaaatactgttaaatcaaggttttaaaaaacatcgcatatgtaaactatgtatacgttgcatacatagtttacatagtgcacttagtatactctgtatacaataatttcatgtgtaaacaagtgaaattgtttctttacaaagattttactttatgttttacttaacgtaatcaataagaaaataaaaaagccgtcgtgaactggcattcacgacgacccacaaaatacaaataagaaaataaaactttcaacaagtattgtatgatatttcattaataaagacaataccagaaagtatataaaagaacgaacataacttttgtggggtcgcagtgtaggcttttttaagcacattttgatcactcaattgcgcggtggatcagtaatttgctggttcactttttctttagatttaatcaacggcattaactactatttgtttcaaaacaaatataccttgcgagtgatggggtgagtatgagcgggagctcccgctcatgtttcacgatcaagctggttcagcttggtcggggttcggggcgacagcgcccgaggggttgaaactggcgttttttttgccagtttcctcttatcttgatacatatagaaacaacaagttttttcaaaactgcctttatcccttgacatgattggcttgaagcgtattattggttaataaagaaaacaataaaaaaacccacgtgagaattcctagtttggcgacccggaacacgtgagttaatcttcaaaatccgtatttactagacttagtctaagacttgatttattaatcgtcaagcccttagttttagtaaatacataaaagattaactcttctcacgtgactagtgagaggagtttttaatttggctggtaagaaagtattgcaagataaggataattacgggaaccagcgaccttggcggcagaaaaaattagagagcttacgttattctgaatatttatcgattctgttatataaaaaaggtcataaagtacaggggtgtgcagatgttttacgttttcgtaaaatgcttgatggaaatacgaaactttatcagacatggttttgtaaaagtcgtttatgtccactatgtaattggcgtcgaagcatgaaaaattctggacaattgaaaaaaattctggctgaggctcataaacagcagcccacgggacgatttatttttttgacgcttacggagcgaaatgcggttgatggtgtcgatttaaaactacgtttgagggctttaactcaagcatttaataaattgattcgttataaaaaagtagttaagaatttactagggtatgttcgttcgactgaaattacgactaatgacaatggcacttatcatcagcatttacatgttttactgtttgttaaatctagttattttactggtaatgggaataattatttgtcacaggttaattggactgatttgtggcagaaggctcttagaagctcatataagccgattgtggacgtcgaagcggttcgggcaaataaatctaagggaaagtcctctttgctcgctagcgcgcaggaaacagccaaatatcaagttaagtctgctgattacatgactgacgatgataatcgtaatcaacaggtgattgatgacttggaacaagccttggctggtactcgccaaattggctatggcggcttactgaagcgaattaaacggcaattgaaattggatgatgccgataacggtgatttagtgaatgttgatggggaaaaattgccagaaccgactgaagctgaattaattgtggctaagtgggatcaacaacgtaaaaattatttgatctggtagtattaaaaaaagcaatcgctttggatgataaaatccgtggtgattgctttttgtgtaactactgccttagctctggcaagctagcgaattcttcttggttagtagtcatcgtcttaaacaaatcaaggatatcataattccgttaaggggcctaaaggcgcacttacacaccacacaaaaatgtggtgtcttttgtacaaactgtcttagatttcgcttcactcaaactaaaaaaatgagccgacagactaaattgaatgacaaattaaggcaaataattttaaaccattttgtttgcttaaaaaaattatcttgatactatagtgctagtagaagaaatcgtttttaagcagatacaaatactcaatattaaaggaggatttttatggctgagaaagataacgaaaaaatgagcagagaagaagctggacgcaaaggtggagaagctacttctgaatctcatgacaaagatttttatgaaaaaatcggagaaaagggtggagaagccacttccgaatctcatgacaaagatttttatgaaaaaaacggaaaaaagggtggagaagccacttccgaatctcatgacaaagatttttatgaaaaaatcggaaaaaagggcggagaagccacttccgatggagataataattaaacacgtaaacggtaaaaataatctgcaagattttttctactagttacagaaaaagatccttttaaggatctttttttgtgctttctattatggcagtagtaaatatctatttaccgcattaaatctgatccttaacaaaaagtagaactccttataaaatacacgaatactagtaaaaatcccgtattaaattaaaagaagcacagtttgtgtgtatcaattgaaagaatataaataacttagattaaaattacactttttagtttgcactccttcgaacttaatccttgcaccacgttgcaactaaaagcgggtacgagctggtagtcaacggtaccggaacgaccaacgggagtgaggataaggagttgactagctaactaaacccagacactgaattggctgaaagccaaagtttcttaaactttgctttcctgccctcacgtagagaaactggtatcggacgaacacaggtttatcgaattcgtgactatgctaggtcgattaatgatttatagaggatgatgagtatattgcaactatcgttatcaatgttaatttaaagcagtttatagttcttaaaaaatttcttataatagattttcaatatctattgtgaaaagtactagatatcaaaagtatctaaatatctaagtatctaagtatctttgtatctaaagatacttagatactttttaataaagcatatataaatggcaagaccaatagcttagcagcttagtaatttaaacattaaacactagttacattattaatatgtcattttaatttttatatctaaatatccttgtatcttaagatacaaggatatagtacaatctatccttttttaaattaggtatccaattagaaatactcaagtgagcttaaaaaaatagtctagttcaaaagtatctttgtatctaaagatataaagatataaagatacaaaagacgttattagaataagtaagttctaataacgtctttttgaaattgtattaccggtatttaatttcgatgctattcctaataatttcttgttctctttcagtaaagtgattttttagatattcatttacagccgtactgactaaaccatatgctttcgattctggtttatttttgtcggtcatattacacattgtttttattaaatctaagacaggcggagccactttaatatttttcctctctgctccagtccatttctttgtttccgttgtttttggattaagagaagatgtatctctactgacatcagctgaatggagtgcttctggtgattcagtttctttatttcctcgattaattaagcccattaacatctaacccctttccaagcttcgtaagtttgttgtcttttgtcaagtaacgacgtttatatatgtagtcagatatatctccctgagtttcaaaggcttgtatcctttcttctaattcacaaaaaatatccgcaaaaagtgcaaacatttttttgtcgtgaaaatcattaaattgtataccttgtgctgtataccattctaaccttgcatggtttgagatgattgtgttgaacacattatcttgaccaaagaaagagactgtgtcgttaacaatttttttgtgtaactctcttcgattctgaaggagtacaggcaaaacgcctgctacttgtacttttacctttgatccaaaatcatcaaccaaactttgtaggtaagaaaatactaaacgtttagatccatcaaaagagaatcgttgtgtttcttggaccaccacaacataatccgcacaaaccattgcattatcaacttttaaatctgttgaaggtggaacgtctataaatatatagtcataacgatctttgatggcgtctaataggtttgacatataaaaagtacggtcatagatattatcaaatttttctataagaaaatccccgtatttacgcatatcatatttacaaccgatcaaatcgagattatcgcttaattctacaatacctttacttaagtcgcctatttctaagcatctcataagtgtgtaatctattttctttaaattaaaggttcggcctaaaaaatctgtagcgttaccttgtaaatctgtatcaatcaccaatacttttttatcaaatattgtagaagctacgattgcttccataacagtatcagttgttttcccaacgccgcctttttgttgtgcgttaataataacttgtggcatgtttgcctcctaatataaataagtaaatgatttttattttctgttaaagtatccttttgcacttttattataatataaaaaaaaaattttacaaggataaaaagataaaagtatccttagataagtttatctttttatctaaagatacaaagatataaaaatatggacaataaacagcgacaaatcaagaaatacatttatctaaagataaaaagataaatgtatctttagatataaagataaaaagatacttttatacaatagtaaaagtatcttttttcaaaaatgcgattgacataggtttttgggtaggttattgtaagtgcaaaagaaaataaaaaaagccactgtgaactggcattcacagcgacccgcaaaaaaatataaagaaaataaatgttcataaaacttattcataggatattgtatgctatttttctctaaaattcaatactgctatagaacatagataatgacatgatttgcggattaatatggctttgaacggcacatcttgattctgttaactctaagtggatcagtgatatgctggttcactttttctttcgagttaatcaacggcattaactactatttgtttcaaaacaaatatacctctgagagtaaacctctcaaaactaaacaaaactttgacatagtgtgggtttccgtttattccttagaaaggaggtgatccagccgcaggttctcctacggctaccttgttacgacttcaccctaatcatctgtcccaccttagacggctagctcctaaaaggttaccccaccggctttgggtgttacaaactctcatggtgtgacgggcggtgtgtacaaggcccgggaacgtattcaccgcggcatgctgatccgcgattactagcgattccgacttcgtgtaggcgagttgcagcctacagtccgaactgagaatggttttaagagattagcttaacctcgcggtctcgcgactcgttgtaccatccattgtagcacgtgtgtagcccaggtcataaggggcatgatgatttgacgtcgtccccaccttcctccggtttgtcaccggcagtctcactagagtgcccaacttaatgctggcaactagtaataagggttgcgctcgttgcgggacttaacccaacatctcacgacacgagctgacgacaaccatgcaccacctgtcattctgtccccgaagggaacctctaatctcttagactgtcagaagatgtcaagacctggtaaggttcttcgcgtagcttcgaattaaaccacatgctccaccgcttgtgcgggcccccgtcaattcttttgagtttcaaccttgcggtcgtactccccaggcggattacttaatgcgttagctgcagcactgaagggcggaaaccctccaacacttagtaatcatcgtttacggcatggactaccagggtatctaatcctgttcgctacccatgctttcgagcctcagcgtcagttgcagaccagacagccgccttcgccactggtgttcttccatatatctacgcatttcaccgctacacatggagttccactgtcctcttctgcactcaagtctcccagtttccaatgcacttcttcggttgagccgaaggctttcacattagacttaaaagaccgcctgcgctcgctttacgcccaataaatccggataacgcttgccacctacgtattaccgcggctgctggcacgtagttagccgtggctttctggttaaataccgtcactgggtaaacagttactcttacccacgttcttctttaacaacagagctttacgagccgaaacccttcttcactcacgcggcgttgctccatcagacttgcgtccattgtggaagattccctactgctgcctcccgtaggagtctgggccgtgtctcagtcccaatgtggccgattaccctctcaggtcggctacgtatcactgccttggtgagcctttacctcaccaactagctaatacgccgcgggtccatccagaagtgatagcagagccatcttttaaaagaaaaccatgcggttttctctgttatacggtattagcatctgtttccaggtgttatcccctacttctgggcaggttacccacgtgttactcacccgttcgccactcacttcgtgttaaaatctcaatcagtacaagtacgtcataatcaattaacggaagttcgttcgacttgcatgtattaggcacgccgccagcgttcatcctgagccaagatcaaactctcatattaaatgatgagtctttttcaagctcattaattgtttgttttgcgaattgacttcgcataatgttttcttacataatctttgtagtgaccccaaaaagttagactttttagaagagtagattttatatctgctctttttttgtgccgtaattaattttaataagccataatttgggatgcttttcgaaattcgactggacttaggtaatttaattttctttttatccgttcgttgttgtaatactgaatataattgtcgatagctgattttagttctttaaaactatgataatttttaccatagaaaatttcttgtttcagttggctaaaaaagctttccattagggcgttgtctaaacaatttcccttacgggacatgctttgaaaaatatgattagtctctaatttatctgtatatgctctcatttgataaatccatccttggtctgagtgaaaggttcgtcgatatggacaattgttcgtgattgtgatggcttcttctaatccttctaagaccatggatgcgtttggttttcgggaaatgcgatatgaaagaacctcgctattgaacatatcgatgaatggatttaaatataactttttggtctgaacgatacctgaggtatcggttttgaagtacttaaattctgtagtatcagttgtgattttttggtggcttatagtggttgaaaaacggcgcctaataaggtttttagctacagttccaactttacctttgtaagaactatatttacgtgatttacgagtatatgtttcaactctgatatccagttttctaattaaacgttgtacttttttcttgttaactaagaatcctcggtgacgaagttcttgagttattctaagatatcctaagatatccgtaatctttatgctgttgacgaatttttaacatttcatcttcaatagtctgatcaacattctttcgattgaatcttttctgccagtacatataagtcgctttaggaaagttcaaagtatttagaaggtcaactaatttgaattgtcctcggaggctgacaatgatgcgtgcgattgattcgtttgtttttgttgggcttcccgttttcgcagcttcctcaattcttttgaaaaggcattttgaattttaagagttcgaacttgtttttcaagctctttaattctttcttgatccgtagatgaagttttagatttattggaagtggctggattagctttcttttcattcatgataggtggtcgacctttcgatttggagagcccatcaattcctgcgtcacgatagtgacgcatccagttaacaatcaaaggggcattattaattcccaaactgttagctacttcgcgataggacatctctgttgtttggtacaactctatcgcagataacttaaattgaacagaatattttttgttttgtcgttttcttaaaagaccttcttcaccaaattcccgataggaatttacccatctatgaatttgattaccatctttcacgttatgtttctttgctagaaaagcatagcctccttcaccggataagtattcttgaacaattttaaatttaaattcaaaagtatatttactcataaaaatagtgacccccaataagttagatttttggtctaacttttgggggtcactataagctcttaataccatttctaaagttgcaatttgtgacgcttgatttcctttccccttttttacaattagcttattagatgaaatggcttgtttcatcaccctattcaaggttgatggagaaatatcaagagcatcacgaatagccctggttgacataataactttgtctgctccagagctaactttattaattagttcaatcacatcatttagccattctgacacgtgactatagacgcgttctgtgcgaggcttcgcccacttgtaccattgaacgttactttcttgcaccacaatgcgcttctcatcgggtgttgcccaggtatctattaattcatcaatataaagtttagatgcaccttcataattgccagaataagcgtcacggacgcaacgctgcatatctcgtacgtctaaaggatcttcaaggtatgaattaaactcatctaataaattgaaggcatcgttttggttttttccagaagagtagcacgctaaggctagtgtaagtatagtattgtgacgtcctagtccttgacctggtttaatgttgtgttttgtcaacataattctaaaccaagcttgatcggtttgttttctatattgagaatgcggactattaattacttttagattgctcttacgcttttccttacttttttgtgtgactgacttactccacattaaaaaaccagcaaatgagtaggtcaattctggttcaaaaaaaataatattatcttcccgcgggatccgaaaaattccaaaactattacatcctacatcagtagcaggtattttttccataatcgtactttttatattttcagaaatctttctagccgcgcttaaaacaggcatactaccatttttatgttttgataaaaatgctgggcgatccaagatatagtaaatttgataccctttatcagttttcaagacaagtgtgggtagaatatggtcctctaagactatgctgctattaaccagattcaggtttcgatctctatctagagcatctttaaaatcaatatcaactacaaacgcattaatttggcttagattacgttctgaatgccctttaatatgtttacggctgttatcatatcctaaccaattaaaggtattaggtgtccaatgtgttagtgtctcaatgttttctattaatgcttcttcagaagtcacgacaaaacccatgtcacggctcattgatgatttattacgaaaaacagcaattgaaccagtcttattatcgttatgtacttcttgattgagttgaactagtttactattttttggtttatatttttttaaaccattatgtaaaataagactaattgcagaccaagatttgtagcttaatttttccgttacggacataatatttgcactcctttcagaacgatattaaccaactgaacatgatctgtgccataatattctagcttgttattactgtagtgtcgtagaccagtgataggttgtccatcattaccgtaataatataaattgttaccttgccattgatactgattacgggtcatttgtttcgattggattttgtaagttataggcttgattttcattgcagctgaactagtggccattagtcttacttgtgtagctggcttcgtgttgggtgtggctgcagtgccttcggtcgttttgatgatgactgttttgacgccagctgcttttaatttgttgtagtcagattgtgtcattgcactttgatatgatgcaacgtcgaccacgtcaacacgtggtctggtggtatctccaatagtccaaacgtccgtttctggagtgcttgcagttaccgtagttaagttaatgtcagcttttttggtcgtggttgcttggcgatttactgcacttgaagcaactgatgtggccttgttggtattctcggtacttgctgctgatttgactgctgtgttacttacttggctaatagaaccagaggcagcactagttgtgtgagcttttgcctcatggcttttgttattactggagcttactttttggcccgtttggttggcggcactcgaaacagcctcggtagtagcgcttgaggtagcagttactgcttgactagtgtttgagttggcagtttcgctgtccgcttgactgaggatactcgaagcagccttggtggttgtacttgaggtagcggttgctgcttgactagtatttaagctgtttgttgcactattgggttggtgagcgatatttgaagtagtcttagcgaccttgttagccgtggtggaaactgtatctgcttgagtagaatcattgcttgtttttgaatcagcactggcggttgtccgtgtgactgtggttgctgttttagctacagttactgtatcagcgtgcgcaatttgatcgttgatgattgcgctgccaacaaatgaacaaaaagtcactccggcaacaagccacagtttacctgacttgtacagtttataatgcacagcccttttgaaatttaatgggttgtctgttcttaagtccataattatatcccctgctttgtataattgatgagtttcaacttatatagtaattataacactcatagccgaatgagataatagggttgttacataattactttaaaagggggagtcaaaaattgaaaataggatatgcacgagtgtctaccactaatcagaatttagatcaacttcgtccaaatcttgcttttgggctagtgcagcgataatttctgtggtaagttcattcatgggaatgcctcctgtgatgttttctgtggttactaaatatcataagggaaggcattccctatttctatacaattcagaaatctcttatgcatttacacaagatattttacgctctcatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtccttgtgggcatattaaggcagttttattaactttaatcgatcgaaaatcacggttcctttgggcatatcggttaaaagatcggacgacagcgactgttaatgaagcactaactaagttcctaaccacttttaatggtccggtgcacagctttactgtggaccgcggcactgagtttagtgggctagtatcacttgaatcacaatatggtattaagacctattactgccatgcttatactccagctgaacgtggtagtaatgaacgctttaatcggaatttacgttatttttatcctaaagggactcgtttttagcacattagtgctcaagatttaacgacgacgttactccaaattaaccagcgaccgcttaaaatactcgactggcaaacactgtatcaggttatgctgacaaatttgtcaaaaagttcggattaaatttgcaatctaccactcaaatgccatccatgccgttgaaaaatattcaacccgtaaggctgacgtcatggtttgtttctgcgtcattgacagttgctgcattaaacgaccctctttcatgtgactgttcatctaagtacagacacatgatatattcaacatatgtatatatcaacatataacgccgatcaatgactccatgaaaggtcttgcagcaacttcttaacaaactagtgctggtgggcgtgttgttgacttgactggggccgataagcggcaactaaccctgtcacagcgtccaaagtcgtaatcaaacccattaaccacatcgctgccatattgtgcatggtaccaattagaatcagcagcaccacatttaacgccagcatgagccatgaaaggaggatgagagattcgaactctcgcgtggtttgacccacctgacggttttcaagaccgttcccttcagccagacttgggtaatcctccataataaaaatatacgttttactgccctatactaacaaaagctagatggaccttgtaggactcgaacctacgaccgaacggttatgagccgtttgctctaaccaactgagctaaaggtccaagttcgtatattaaccctatcgcggcggaggggatcgaacccccgacctcccgggtatgaaccggacgctctagccagctgagctacaccgcgatctatatattgaaacaataaatgtatttaaacatttaatcgggaagacaggattcgaacctgcgaccccctggtcccaaaccaggtgctctaccaagctgagctacttcccgttaaaacaatgcacccagtaggagtcgaacctacaaccttctgattcgtagtcagacactctatccagttgcgctatgggtgcataataagtgccgaggaccgggatcgaaccggtacggttatcactaaccgcaggattttaagtcctgtgcgtctgccaattccgccaccccggcatctttgctatagtagtaacggattactactaagcggaagacgggattcgaacccgcgacccccaccatggcaaggtgatgttctaccactgaactacttccgcaaaattgatatgccgactagaggattcgaacctccgaccccctgtttacaagacagatgctctgccaactgagctaagtcggcattatcacttattaatgccatatatttacttttatgaaacatagcactaatttgtgctatgagccgtgacaggctcgaactgtcgaccctctgattaaaagtcagatgctctaccaactgagctaacggctcaaaatataatgggggatacagggctcgaacctgtgacctcctgcttgtaaggcagatgctctcccaactgagctaatcccccatttattgcctcttttaaaataaatttttaaacagttaccgttaaagtaacttattcctcgtgttagtaacacgggggatttttatatagacgtttttaaacccccgttgcgcaattaaactgaacttatatttctaaaacatactaattaataaaaggctagttactgaccaatttttggttagtgactagccttttattttattcataaggtagattgcaaatttaatccgaatttttggacaaatttgtcagcataacctgatacggtgtttgccagtcgagtattttaagcgttcgctggttaatttggagtaacgtcgtcgttaaatcttgagcactaatgtgctcaaaacgagttcctttaggataaaaataacgtaaattccgattaaagcgttcattactaccacgttcagctggagtataagcatggcagtaataggtcttaataccatattgtgattcaagtggattgaagtcaatatttgagacaggttttaagagacattcaggaccgcgtttaccttccacagttcaaataaatcattaatcgcgattaataacttatttgaaccctggaaagcattaaatttctgtctcaaatattgactccattccaatggattctgacgacggtttgggttacttgcaaggtgagaagatgagctacgttaaccgtactgcttcagaaggaaccttgttggcccccgtttacggtggtgtacctaacatgattattgaggtggacaagccatctacttctttgaagtagctgttgccatttctgattactcgaacggaattaatccatttgaccaaccaggcgtggaggcatataagcgcaatatgtttggattgttggggaagccaggatacgaagatattacttatcagttacaacaacgcttatgaataaaataaaaggctagtcactaaccaaaaattggtcagtaactagccttttattaattagtatgttttagaaatataagttcagtttaattgcgcaacgggggtttaaaaacgtctgtataaaaatcccccgtgttactaacacgaggaataagttactttaacggtaactgtttaaaaatttattttaaaagaggcagccaggttagtggagtatagtgattaccggatagctggcggaaagtccatgaaagtaagtaaattcggcattttaagcagatctttgattaatttgggataggtctgatgccagttgctggcgaactcattcagtttcagttcgtctgcttcacggttggcggcccgatgaacttgtttaaagtcactgatcacggccttgcggtcttttacgcgaactttgttcatcagattccgcccaacatgaaccaggcaacgttgtcgtttggctttagggaaatgccgattcaagccttcatccaaaccaactaacccatcggccacaaacaacagcacatctttaacgccctgcttgatcaaggttcccagcagttcagtccagattccagtcgattccgttggcgccacttggtagttcagcacttctttcgtaccatctggacgaatgccaatcgtaatatgaacggcttctttttgaacggtatcccgctttaacggcaagtaagcggcaaatctttgctttaaaaaaagccggagttcaaaaaatatttgaagagaaaatttctggtaaaaacatggaacgcccaaagttaaaaaaaatgctggagtatattcatgatgacgatgtagttacagtaataagtttggatcgcttagggcgtaattcgcgtgatttaacagatgttattgataaaatcagacggagaggagcagttttggatgttctagatttacctacgtttgcaggtgttgaagacggcaatttaagagctctattaacaaatcttgtattggaaatatataaatatacggcagaagaagaacgccaaaaaatcttaaaaaggcaaagtcagggaataaaaatagctaaggcaaagggcatatataaaggaagaaaaaaagaatatgctccaaatggttcaaaacgcttcatatataatggggttttaaacggaataaagaacggaaaaagtattgcgcaaatttcataaaattaactaacaaccaaatgttgatgacccgtacgggattcgaacccatgttactgccgtgaaagggcagtgtcttaaccacttgaccaacgggtcataaatataaaatatacaagctacggagaaggagggattcgaaccctcgcgccgcttgcgcgacctacacccttagcaggggcgcctcttcagccacttgagtacttctccaaatgggcctaaatggactcgaaccatcgacctcacgcttatcaggcgtgcgctctaaaccagctgagctataggcccatataaaaatataacaaaagcgggtgacgagaatcgaactcgcgacaacagcttggaaggctgtggttttaccactaaactacacccgcataataaaggtattaaattgtgaatggcgcgggacagaatcgaactgccgacacatggagcttcaatccattgctctaccgactgagctaccgagccattttttacttgccgttaaagcgggataccgttcaaaaaaaagccgttcatattgcgattggcattcgtccagatggtacgaaagaagtgctgaactaccaagtggcgccaacggaatctggactgaactgctgggaaccttgatcaagcagggcgttaaagatgtgctgttgtttgtggccgatgggttagttggtttggatgaaggcttgaatcggcatttccctaaagctaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggaccgaagctgcagtggttgaagttccagattcaattcatggtggatcttcataacaccgtatcgctgcttaaattccgcaaagatccgcagaatccgttgtttcaagtctgcatcttcggcccggcgttttgaaggtttgggggatcgataacgatagtactgagctctggaaacaccgaggattcggcacatcttggttacttggtggtgatggctttcttggtgaatgtaatcaaagatattggttacttctgcgcaaggaagcccagggctttttttaggatttcgttctcctcagacagcgaagccagtcgcttttccatcgctttgatttcgtctggcgatttaccggattgagttttggcctggccctgatttctcgaccactggtttaaatcaaaaatggaccgctgatatgacctatattcaaacgaagtgtaatggctggtgttacttatcaaccatcatggacctgcactcacgacggattatcggctattcgttctcaaaaaagatggatactgatttagtcttaaagaccctagaaagcgcggttaaagatcgaaccattactggggacctgattatccatacggatttaggaacacagtataccagcgatgattacaatcaacgtttaactgaactacatatccgccactcatccagccgtaagggttgtccgtatgataatgcgccaatggaatcctttcacgcttccctcaaaaaggatttctcgaccactggtttaaatcaaaaatggaccgctgatatgacctatattcaaacgaagcgtaatggctggtgttacttatcaaccatcatggacctgcactcacgacggatcatcggctatccgttctcaaaaaagatggatactgatttagtcttaaagacccttgaaagcgcggttaaaaatcgaaccattactggggacctgattatccatacggatttaggatcacagtataccagcgatgattacaatcaacgtttaactgaactacatatccgccactcatatagccgtaagggttgtccgtatgataatgcgccaatggaatcctttcacgcttccctcaaaaaacggtttgattgtcaccactatcctgatgccgctttactttcaaacgctacttggtttgtcaccgttgatttctggcttgtccttagtgccagctgcggtgttgctgagtattttgaatccaattagcgggcgcctactggatcgctttggaccgcgtgttgtggccatgattggcatgttgttgattactggcggctttggtctgttagcagtctttgcccatcatttaccgctgattggggcaattatgttggcgatggcatggtttgattgtcaccactatcctgatgccgctttactttcaaacgctacttggtttgtcaccgttaatttctggcttgtccttagtgccagctgcggtgttgctgagtattttgaatccaattagcgggcgcctactggatcgctttggaccgcgtgtcgtggccatgattggcatgttgttgattaccggcggctttggtctgttagcagtctttgcccatcatttaccactgattggggcaattatgttggcgatggcgctatatcggaaaagagaagcagaatcaatagcttgggttaattaccttgaggcttttttgaagttacagaataggcagtatattgaggaacaaagcgtattttcagatgttgaagtaggtagatttggaaccaatataagtacggggtgaaatctcttaatttagtgctaccaattgccattagattttttatctcttagatagggtagcgtcaagaatcttgtgtaaatgaaatgccttcgtacatataatacaacgccaacagcaagccaatcaggcccacgccagcaaacacagcgaaggtaacagcaaaaccgccagcatgacttcgcagcgtggtttgcatgccatccaacaacactgtggcgaacatgacaccggcagaaccgaataactgacgagccgtcgttgtaaccgcagtgccgtctgccacgagctcattcggcaaagcattcgcgccagccgtcactgaaggcatcatcacaaaggcattgccggcttcagttggatgtaagctgattcctgagacaacttttaagagagggtataatgaataaatcgtctctcaaaaggaaggaatttttacctgccaactcgttacgacaaagaatttaaacaaaacattatcaacctatataagcaaggcgaatcagctgcccaactggccagagaatatggcattggctattcaaccgttcataagtggatctgaataaacaaccttagttgtttaatggagaatagcgggatcgaaccgctgacctcctgcgtgcaaggcaggcgctctcccagctgagctaattccccatgtatgggcctaaatggactcgaaccatcgacctcacgcttatcaggcgtgcgctctaaaccagctgagctataggcccgatacgcgtgctcattgcgtcaccgttaccaccgaagtaatagaatttattaccttcttgataataccggttacgatattgaacgtggtccgcgccgtaatattctagcttattattgccgtaatgacgtaagccggtaactgcgtcaccattgctaccaaagtaatacaactgatttccctgactagcataacgattacgatactttccagggttcaaataagttattaatcgcgattaatgatttatttgagctgtggaaggtaaacgcggttctgaatgtctcttaaaagctgtctcaaatattgacttcaatccatattgtgcatggtaccaattagaatcagcagcaccacatttaacgccagcatgagccgaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggcactggataaacacattcattatcgcgggatggagcagtctggtagctcgtcgggctcataacccgaaggtcgtaggttcaaatcctgctcccgcaattatggtcctatggtctagctggttaggacgcctgcctgtcacgcaggagatcacgagttcgagtctcgttaggaccgtttgagaactttaataagcatctcaagcgcaccacccaccacaaagaacaatttccaacggaagattcactggatcgcttcctggtttctcagtttaatgtttataacgagaagtctctgaagcggatccaccgagggttcaaaggactccaagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaatggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcggagattcaaatgtcaacaactaattttaattaatttgaattaaaatttgaaaacttgatgacgtcatctctcgcgacaacagaaatatactatacactcgtttttaaggttcgtcaacacttttgccatatttattttcgagcgctcataactgccgttgcggttattaccagtgttaatcccagcgtatgagtagcgttcgtaacccaaaaactctgccaattcggtttgaagcagctggttaatcgcaatttcgaggtggtgacgaagacgttaccaaaggaagtcgcgaagaaagcggtatagctgcgaattcgtgctttgcatctacaaaaatgaccgcctaccaaaaagtagacggtcatttttgttgcaactaagcatgcttgactgggtactgaacatgatctgtgccataatattctagcttgttattgccgtaatgacgtaagccagttactgcgtcaccattgctaccaaagtaatacaactgatttccctgactagcataacgattacgatctgcttaagcaagttgggacgctgttcaaccttggttttggaagccgaagccgctttccacttattgacggtaacggagtggatatccagttccttcatgagccgggaaatccgtcgtggactgcaagcgataatttctgtggttactaaatatcataagggaaggcattccctatttctatacaattcagaaatcttttatgcatttacacaagatattttacgctctc

SEQ ID NO: 35-41 - skipped (7 entries)
